United States Patent 12,215,316 (MATERIALS AND METHODS FOR TREATMENT OF USHER SYNDROME TYPE 2A) - sequence listing, part 2

SEQ ID NO: 5266 - DNA, 800503 bp, Homo sapiens
tgtttgctctgcagaatactttacctgggcacccaagtcttccttccagcattcctgctgctacagcctatttgctgagtaaccaggggttacagcagcgttgccaggcaacgagggacagcggtcctgttgaagagccatttgtcacactgaggggactggttgaaatgcaataaagaaatggtaactcagcttatttatcaatacaattacttgcacagtattagggatccatgtgtaacctacaaattcatagtcatatgaggaaacacagaaacattttgctaaatattaaagcataggacagacagatggtgttgggtttctaatcagctttactctgagcttaaagttgctgcacatgctgggataaggggaaaggcccaaagtcctttgccagctttattttgggcatctgtaagttagctctgggttacaatgtacagtgcatgtgtaaagaaaatctacaagattcttttccctgttaagtagagctggtaatgccattgctaattccctggggtgaagtaacaacacaaaattattgtatgtgtaatatattattaataattatatatatataaaacacacacatatattatataaatatttatgtataactggttataaatattactggttgtcctgtggacttataaagtgcttgatttgcccaatgcaatcaagagatttaccaaaaggatgagtattttactctgagcactgtgcttcaaaatgttttttgagaagttcagtagtgttgcttctaggagctcaaagtcctcaggcctgggatgagcttcagttttaaaggtgcagcagctttcccttgacgccctacgtttttgattcccagataccagcagctactcatgtcttcgccattgctaagaacgtcgttggtattaccttactctgagaacgtgtctgcagtttccagaaaatggagtatcgcaacatcacttaaagtaccctgcttcaaagtattgctggcaagtggcgtgggcctgattatttatttagaaatgctttatcaggaggagaatgcttttttgtaaacatgaattgcccagttctttcattgggctctggcttcttgtttcaggtcattgaaatgttgatctttgcctattttgcttcaatatccttgactgagtcacgaggtcttttcccaaggctggagaacgtgggagctttcaagaaagtttccatcgtgccaacccaagcagtatgtggactcccagaccgaagcactttttgtcacagctctgctgctgctgaaagtattcagttctgtacccagcggttttgtattcaggattgcccatacagatcttcacaccctacctacactgcccttttctcagcaggcctcagtagctgcatcacaccagacaagaatgatctgcatcctaacgcccatagcaattctgcaagttttatttttggaaatcacaagagctgcttttcttctcctccttctccaaagctgatggcatcatttaccttagctgtatggctgaaacctgagcaacaaggtgtaatgtaagtagtagtgtaggtataagctttcataggtccccaaaaccagtagtagtgaagatcatttcagcctgaattccaaaccggaagtgaaggctatatagaattcatggtattgaagactaactcttccagttgtttccccaattaaaatttttttctcttctatggatgaaatggaccatgaaaaaaaatgtgaaaatagtttatcaaaggcaaatgtgtttatgcaggaatcatttattttctatagcttagcgcgacctttggtcttagccttcaaagcctaaagaagactcagagtgagttttaaggcatggaaacttgtaattaatacaaataattaatattttcaaaatcttgaactgggtttatataatcaacatttccttactagggtataacattttcattaggcagatagttctcccagtccttgggactgttttcttcatcctcgtttccccaagaagagctgtttgtttgactcatggaagatgttcagtaatataaattgaatatataaataaccctccatctctaaaaacatatagcttttagttctttatcttgtggtattttcattttccaattagttaggaaatatgtaggtaagtgtgagagattctcaaaagctttcatgctgttcatcccagagaaatgccttcaatgagtctgggtcttattactgccattttttgttatttaatcaccagtttttcattctgtaatcttttctcaagctgatatctaatgagtttcttctaaatatttattgccaacctggagattttaatatacaggacagttttgaggaatttttgcttatcttttttcttcctagagggcttttggccctttctcttgtgacattttctgtgtgtgacagcgttggctggatatctaaaaacttgtgaaacaaaccagaaaaggattacaatctcataagcaaataggacttaaatgtttttggtgtttagtttcaatttgccaagtgaaagttggcatgtcttcattttgttttaaatttggattaatcacaaaattaatcacaaaccattcccatttctacatctctcctcaaagaaaaccttgttttcttactgtttgaaattctagtaaattcaagctactcagtttatataattaacatctgaagagtcttaaaacattgtcttttgacaaatagggctaagataaaatatccttctgagcttgtagggacatatctgtaccaaattcatcttctattgacatcattttgtataaataagacagagaagtatttacagggttggaagaacatggttaatggttttgagagttccttgtatcaaggtcgtttccattttcaaaattaaaatacctttgggaattgggggaatttcggggtgtttgcactagataagtaaaacaaacaaaacatggattatccaattattgtttattcaggagcagaataaatccagttcctaaatattttgctacctgccttcctctcacatttattatctaccaaagctagtatgtttacaagcaaacaaaatagcaaggaagataatcaataacatattaagaaatgcattttcagtaagcttgggaaaataagtctgcatttggtaaatacattcttgagtaatggtcgaattctcacttgtagatttaaacagaagaaaaatgaataggggcaaactcttttcaggttaagacctgatgggtagggataaaaacaaattcacttcagtaaattagaaatattcaactactgaagggttaaaaatataatttgcagtagaatttatataaaacttttatttctacttatataaaacctttatgtcatctaaatctatttgcctaaattaaaaatatacttgcactcataactttataccaaatatacatacaaaatatagtaaaattgtgacagtaaatgagggactattagtgttttacaatcttattcttacctcccaactcaggaaaaaaatagatgcaagtgatagatgcaagtgagaagaaattatgtgtgaaaaacatgccctttaaggaaagctttaaaccatctttagcagtaattcttgattggctcaattttatacatttgcctctctgatacttcctaccaaatttgatcacaaactcatcattttttgagagactactgtatcctaggtgtttgtgtgtgtatcctcagaatactcatgatctaaatgatctaatggagtgtacagatggatgagtgttattacctaggcagcacagtgtgttaagtgagcacaaagtgagacccctcaaccgaccctgagcaggaagaagggtgccaggaccaagcataatcattcagataccaaagctaagtaggaggtaaccaggtgaagaagagacctcaaggtctgaaaggtgtgtcactctaataagggtagagataacttaaaataatttgataactgccctgacacaagacctggaagttttctgaaaactcttctagtttttcaaaatcttatttcactgtgttctagaaggctgaaggacctttcacctcagatatttaacatgatctcagtacctcagttggactgtacggtcatggagaggtagccagtcatcttacagacactggctttggctttgtgccagttgatgatggggtgagtagagactatagctgtccattcttcatttcaccatgggaattaaatagagtgattctgacttcagggctaccaatttagagccttccatggacactaaatttgctttacattaaaaaaaaatttttgcactgatgacttaatactcaagcggcctgtagtgtgttgtaccacttcctctaaaagaaatagcaggagaactaatgagccaataacctaaatgttagttttgcagaatgattcaaccactttagtttccatcatgaatctctaatgaagggtgctgaggctctggggaatatattgtaaataagaattctattttttattgaaataaaggggcttcttcattggaataaagctttcattgaatataatgacattcaggcacttattcatagtacaccattttgagcaaagtttgaggtcattttaacaccactgtaactgcacaataccttagcatgtctttttggttggatgctgaccttttctctcttttccggttgcttcctaaggtgtgttatagaaaagacagtagatgggcagattgtgttcaaacttacaatatctgagaaagagaccatgttttattatcgcacagtaaatggtttgcaacctccaataaaagtaatgacactggggagaattcttgtgaagaaatggattcatcttagtgtgcaggtgagtaaaataaaaaatatttaacatttggttaaacacaaggatttgtcttcctttctctcttttaaatggcatctactcacaaaatctgcagcagtatcttttagatttcaggtgtgtataaatgacaactaaagaagaaaaatatttaaatgacctaatgatgtatctcttgatatactagcatttcctcccccaaaattgctgtaaaagctctcacagaaacttaaagacaatgctatctgtaattgtaatatcctcagaaaatttttgttttcttgggttcgtatattctattttgtttaaaaatgtgtaagggctcatttgatgtctggtactaattttactagtcatggatgtattaataccccagcttgatttttacatctgtctttctcagcagctgatgatgtgaataaaatttgtctgttgcattaaaatggtgaccttagaactaatgaactttacacttgaggcactcaaaaggtgttatattattattttagttgtcaaccacagtttgtatgagccttagaagctgctaaaggctgagagagctgtgacatgtctggtatttacagtctccagaagagaggcacagttcatccttttgttttttcagggcactggaatggcccaatacagttaaagccacacctgcctttcaaaccaggtgtattagtccattcttccactactataaaaaataccggagactgggtaatttattataaagaaaagaggttcaattggctcatggttctgtgggctatacaggaagcatgattctggcatctgctcagcttctggggagaccttagaaaacttacaatcacggcagcagacaaaggctgagcaagcacttcatgtggccagaatagggaggaaaagaaagaaagggaggtacttcacacttttaaaccaccagatctcatgagaattctatcaggagactagcactaggtggatggtgttaaagtactgatgagaaaacgtctacatgttccaataacctcccatcaggccccaccaccaaagctggggattacaattggacatgaggtttgggtggggacacagagccaaatcatgtaacttggggtgctgggtaccacagtttccagtatgagctctcatatgagcatccatccagtggctcatgtgaacctcatttgaactagaggacatttacatccttgttcattttataaaaattatctttgatttctcacttttttttttttttttaatcttgaagcagataatgagtgtgcgtcctcagagggtcttgataattgttcattgttttggctttcagatactaagatatgagtttagcaaatgtgattggcaggggtcagagttttcatacacaactagggttgaaatgatacacaaaggggacgtcatgtctgacgtcaagccttgtgcataggacatgatggtttctgattctcaatgcttattctccatgtgttcagtagttaacagataggagaccaatttgtcctagtcttgaagtttccattgtcttgaagtctccattctgcccactgaccagtcctacagaattgggttttaatattaaaaacgtagaaatagaaacttttaaagacagtgccatctttgcagaagatgccaaatagatatgtttgttgcatatttttgtatcaacaatgacaaaaaaattatctttacttgcctttattttgtgttatctgtgaaactgtgccatgttttggcaggcagtagtacattaaaagcttcacaaagaaagtttaaaatctaaatgcagagcggtaaccatgactgaattactcccttggggataaaatgctcttagagtgcctactgaaatcagcattatcatttcaatacatgtcaaatatgagtcatttactagtttaggcaaaatttcttcatgaatctttaaatctttctcttctttcaagaaaaggttaaagtacttatgatttaatgagactgctttatttcataactgtttgactatcaagagaaaacttgtccttttcgatttgtacactcttttatttatttttttgcataagttttaaactattctgcattttatattaaaactacagaactaggcagtcacaaaatgttagaaaaccattcagatctgtcatttaatcatctagcacttattaaatatttgaggggtatgcagcattatgggaatctggatttattcaaatgaaaattaaagagcaattatttactctaaaatggagctctatataaggttcctttatattggacaacagtctgaatatgtttaaggtattatgaaatttataaaaatccatattatagatttttttttgagacagagtttctcccttgttgcccaggctggagtgcaatggcatgatcttggctcactgcaacctccgtctcctgagttcaagagattatcctgcctcagcctcccaagtagctgagattacaggtgcctacaaccacactggctaattttttgtatttttagtagagaaggagtttcaccattgttggccaggctggtctcgaattcctgacctcaggtgatccacctgccttggcctcccaaagtgatggtattacaggcatgagccagagtgcccagcctagattttgaaaaaggaatgtactgattactcaaaagttgttataagaaataatggaggccaggcgcagtggttcatgcctgtaatcccagcattttgggaggtagaagtgaacggatagctcgaaccaggagttcgaggccagcctgggcaacatggcaaaacctcatctctacgaaaaaacaccctaaaaaaattagccaggtgtgatggtgcgtgtctgtagacccagctactcaggaggttggggctaaagtgaaaagatcacctaagcctggaagtcaaggcttcagtgacccatgatcatgccactgcattccagcctgggcgaaagagcaagatcctgtctgaaaaaaaaaaaaaaaaaaaaaaaaagtgacaggaaggacaggagattaggagttgggaaatctgatttaggttatgctactctgtagtcttaagaataaaatttataggaatccatatgatagttgtttaataaggaatgtactaattgcttaaacgttgttataagaagtaatggaagctgggcacagtggctcacacctataccctgcccgccttgacgtctcaaactgagtcatttgactcagttttcctatttacataagaagattgaactagatgaacaaaatgagggccttttgaattcttcataaacaagtaagtggagtgtggagtgtagcacaagtcattaaagtatggcaagctgttgagttgtgtagggttatttaggtagtaagtgacagagccagccccattaaccaatgatcagtcttgtgctttttttctcttctcccatgctgcttggcatttacataaaaacatttttttgctagattttctggacaaaatatagagaaatgtagattgttactattccattgtataactgcaagaacatttccagaaaaaatattttagtataaaatgtaacttactgttgcatgattatataatgcatctaaactccatttaatttggggattagggacttttatcatgctgggcataggacagaacaaatgattaataatcttgtttagtcaagtttcaaactacaaacctgcactttatgtatatgtggattttcacccatcttccaaatggccacaaattgatgaatttatatagtgtgtgtgtttctgtgcatgtgaaaaaataaaacatacaactctattcgtggaatggcccagaaaccagaattttagttcgttgcttatagtgattttttactggttagcttatacctggtggcataaaattaattagcagatctcaacttatgctttatctcagacagttcacttgtatcagctttccatcagtaaaatcagaattctaatttaccaaaatcagaaaaaaaattattttaaataattaaatatctgggggaaaagatgtcaggaaatccagacataccaaaattggaaatcgaatttcctaaacaaacaaatagacaatatgctcaatattgctatggtaatgaatctcacagcttttattccaaaactagcattttaaagtgtcaatctgttggaaaatgattagtgtttaaattaatattcatttatggacttgaatctgacaggattgccaattgaaattttactttggggtttaatatattggctatttcaaattatatcaagctaaaattcattgtgtcattttttatactaaaactagaaaaaatcaattcatagtttttattatcatatagggaacactgatcatattagcaaaatttttaaagcttagttttcatattaaatcagcacatgctgtagttataagatttcctttggttactcttataaaagttttgaaatatgtaaaaaaatttactttagcatttcgttatggattggtaggtaaaacaatatggaaataagtatatgtgtttagtggcatttcatttaaaagtaaaactttagggttttctttgacaatatattttgccttaagcagttccacacattttatagcccaaatagtgtcaaagaatcatcagtatagtcatccttctagtaattatgcagaattgcagtaaaacaattactacgatttgaagctgatgaaatactacagctgtggaaccaagaaatgatttagcattgggcttgttcacattttctatgctattttcagggctccttgatacattgacaattcaagagccatagatgactctagctacaatagtgtgaaaaagagcagttctaatatgatacaatgaagaaaaaaatgcatgggtaaataaagttttaggaatcaatatatgaaggataggagtttcataatcacagttcatgaagtatgctcttttgatttatgtattcaatctaagaaagaaaaactattgatagttctggaggaaaacaaaatgcaatttaaccaacatttgttagaatagataaaccaagtctctcaattaatctctgaactgtatgcccatgtgcacactttataaaggtgtttccatgttcctattgattgagggaacataaaacatccatgtcaccttatggaagcctcctcattcagttcagtaagctttatggcatagaattgtcataggaataccatcccagccccactcccattctaagagaatctcaacccatattatttctttaatatatcattgcatttagctctgactctgtgtgtgtgtgtatgtgtgtgtaagtatgcatgcatatgtgtgctaaatgtttctttgtgcaaagccttctctttatatctagccagctgggttaacagctcaagttagttgaatagttttgggttattcaaaataaattaagatcaatagaatataatgaagtttttcagaacaatcagttacaaattatcatagctgctattaatcattgatttatgtgcactatattaaacatgttacatatttgcagttatacaatgaaatagtgacatgcttgtaacatgtttaatatagtgttaataatagctctgtgccactgacttatattatctccatgacagagattttaaaaaattagccttaggaaatttaaactacctgcctacatttatagtcccaagcttctctgaccttaaactaaaagtaataacttgccatgaacatgggtcactgagcagatctaaataatagtttttaaaattctccaaaccaaaaaaaaaaggcacagaatcccaaaagaactgaaaacatatatttataatgtaaatataattttgtatatttatacatatttgtaatataaatattttcaatgcttcagatatttacatgatttatacaaataattaaagtcaatatattttttaactatacccctcattgatacaagcaatttaaatgtacaacagaatgtaattttgtataaagttctgcgcaatattttcatgttttatggcagttgcgatagactacaatggcttaaagaaagaatatttcccttaagccagcctgatcacctgacccatgccttatagaatcaacccttattacaataaaatacaaagaaggaagcacttcctactttattatggaagaggtaaaaccatccaagtaaaaaagtaattattctctgtacgttttttgcatgtgattttaaaatgcaatatttaagcagaaggcaaggctttaattcttgaccttttagtaaaaaattgtgcaaccctgggaaaactatgtaactcctcaaaatgttaggatacccattacaaattggaaacaaacaaacttggcctatttagcttacaccataaatttgaacatataaagaaaatattgtctactaaaacactttatagcctataacttcctgctatgaaggagcttacagtctcttcagaggataagcaatcaaataattacacaaataaaggcaaaattataattgtggtaagtgctacatgatcacatgaagaatgatttggtcaaaccactgaagtcaagaaaagcttccttgagtaaatgttattgaatatgtgtattagttttctaggcctgtactaaaaaattatcacaaactggtggcttaacacaacagttaattcattgttgaagagttctggaggctagaaagctgaaatcaagttgttagaagggccatgctctttctgaaacctctagaatccttccttgtctcttccagcatctggtgtttgcacagacaccagagtatgtgattgtgctacctcctggggtttgtctgcccacagcaaggccgggaacccagaaaagaaaagaggagtgcccagtgtagccaccacccactgcatgagaaacagagctggcagcaatccttgatgctccttagcttgtagctacatcactccagcctctgtctgcattatcatatggtcctctcctctgatcgtgtgtgtcttctcttcttataaggacatcagttgtactggattaggattcttcctaattcggtaggactcatcttaacaattacatccaaaaagacactacccaaataaggtcagagtcacaggcacatagggttagggcttcagtatgacttttgatgggacacagttcaactgatagtaagatttattcaaaagaatgcataggatccaactgggcaaagagaattgataagaacattccataaatgcatagcaaatagtgtaaatgcccttgtataaaaagaaatatgttacatagactaaaaaaccaaagtggttagagtgtcgctggcaaagtgggacatggtgtgaaatgaggacagaacagtaggaagaggctatgtgttaaagagaatcactggatatgttaagattttttttttaaatggaactctattgaactgttttatgtgaaggacaggagatgagggatgaggataaggaaggaaaacgtatgatatgcacagattattttttcctaaagatcactttggctgcagtgagggagaatggtttgcttgaagacaagtgtgaagggttgttatggtattttcatggaccaagtcagatgtaagtgttacttacttacagcatgaagacaatagtgaatatgcaaatgaatggtcagctttgagaggagtttaagaattaaattaaagggcttgttgatgaaggaatatgtaatatgagggaaagggagttgatgaatcccagctttctggcttatgtaattgcaggtacagtgatttctttttctcaaatagaaatactggaagagaatcagattttggatgtggagcacatatgaattagattccagtttagggtaataattctcaactatagaaattattagcattattgagaaactttaaaaaatattctgatgtccatatccctttatgtcttcattggtctaggtggggcgcaggcattatttctttctttcttccttccctgatggatttaaaaaggtgtaacaaaagaaaatatcagtctaccattgatgagcatttaggttggttccatatctttgctattgtgaacagtgctgcaacgaatatacatgtgcatgcgtctttatgatagaatgactcagattcctttggatatatacgcaggaatggaattgctgggtataatggtagttctgttttttttggtctttgaggaattgtcacactgttttctgtaatggttgaagtaatttacactcccaacatcagcctattaagcattcctttttctctgcaacctcactagcactgttgtttcttgactttttaataacagacattctgactgatgtgagatggtatctttcattgtggttttgattgacattgctctgatgatcagcgatcatatgcttgttggccacatgtatgtcttcttttgaaaagggtctatttatgtcctttgcccactttttaatagggttgtttttttcttgtagatttgttgaagtttgttatagaggccagctatcagacctttgccagatgtatagtttgcaaaacttttctctcactctataggttatctgttcactctgttgatagttcgttttgctgtgcagaagctctttaatttaatttgatcccatttgtcattgcttttggcatctctgtcgtgaaatctttgcctgttcctatttcctatgtccagaatgctattgcctagattgtctttcaggcttttagttttgggttttacgtttaagtctttattccaacttgagttgatttttatatatggtataaggaaggggtccagtttcaatcttctgcatatggctagccagttatcccaacatttattgaatagggagtcctttccccattgcttgtttttgtcagctttctcaaagatcagatggtggtaggtgtgatggccttatttctgggctctctattctttttcttcggtctatgtgtctgtttttgtaccagattcatgctgttttgcttactgtagccctgtagtatagtttgcagtcaagtaatgcaatgcctccacctttgttatttttgtgtaggattctctgtctatttgggctcatttttggttttatatgaatttaaaaagtttttttctagttattccaagaatgtcgttgtttgtttgatagaaatagcactgaatctgtaaattgctttgggcaatatggccattttaacgatattggtccttcctattcatgagcatggaatgtcacacaaaccaatgatatctgtttgtgtcatctctgatttatttgagcagtgctttgcatttctcattgtacagatctttcccctccctggttaactgtattcctggtattttattctttttgtggcgattgtttcacctgcttctaatcaaatctatttagtagctgttattaaactgtgtagccattagtatacagtagtactccattacccttggctttgctttctgttgtttgtcacccacagtcaaccacagtctgaaaatatcaaatggaaaatttcagaagtaaacaattcataagttttaaattgggtgctgttctgtgtagtgtgatgacatgtgaggtggtcaccatacctcctgcctgggaggtgaagcatccctttgtccagcagcttctccatattgtctatgctcctagcccttcagtcacatagtagctctcttagtaatcagatcagctgttgctgtatcacagttgtaacttgtgttcaaggaaactgtatttcacttcttaatggccccaaagtgcaataatagtaatgctggcaatttggctatgccaagaagccataaagtccctcttttaagtgaaaaggtaaacactctcaacttaacaaatgaaagagaaaagatcatatgctgaaattactaagaacttcagtgtaagaatgtatcttctgtccatgaaattctgaacaatgtattgttataattattctattttgatagttattgttaatctcttactgggcctaatttataaaaattaaactttatcttgggtatgtatgtataggaaaaaacatagcatatattgggttcagtaatatccacggtttcaggcattcactgggagtcttgcaacatatcctcaatggataaagggggactactgtatgcgcaatatatgtatacgcttaaaaagagttttgtttagctagtgtgtgtaagaagattatcacaagtcacactgtagtgtttgccttttgccagtctgaatgttatcatcagtctaatattttatagcaaagatttaagttcattgaaaacttccctatggaaacacttccaatcaagacctacagcaagccatgaataaattaacatttaaacatgaaaactgatatttgaagaagaattagcaattaataatttctgctagaaaatggtggtttctcagccaatagctataaattgtataatatatgtaaaaggaaatatatacaaatatcatatgggacatatatcacatatactactaaaattgaaaattgctataaatagaagactatgttccaatgtccactgatttttttttttttaacaatctctagtcttgaaaatgccactatggtaattctgtcaaatttgtaatggttgggatttgatggtagtgcttttgaaacctgtattatctaatggaattgtcatttatattatatcattttcacctaaaagccaaatacaataagacttaaattatttttgctttttttgtggatagtcatttttgtgcccaaagggctaactgatgccttcagttatacatgaacaattcgcactaacgtcaggaagaacagtgtgcatataacctagggcagaatttggtctatggaatgtatcactcagtagtggaatggagattatgactttatttaaacatggacttgagtagttttatttttccttactgtttcccttggcatttctttctctaaagtgcaacattcaaaagtattctatgcagctgtagtgtcctggatgcataataagggcatatgttcaaggcaagtttaaatatccacataagccaaagacagagtaattaacattaaaaaaattaagacaacttttccaagaatgaaaagctttaatagattagctaattttagaattatttaacaacaactgtgaaaaattattagtatttacaaatatgtatatataaatatatgtaatgtcttatgttagacagcaatttcattctgctctctaatgattacatgacatacttctgaaaaaagtcaaacagtgtgttctagaaggacaaagaaataattggttcagttttgcttatacttagtgttcaattgttatcaacctggggtgggaggaagggaaagaaagagggaaggacagaagagagcaagaaaagaaggaaggaggagaggaaggagagatggaagtcatgtgacatagctagggatttggggcaaaattcaagacccatgttttccttgatggaaagccaaggaacctgagaaggagagtcagcccatgccaatttcactgtggtagaggtgaccaagaaagtttacattatggatgtatagtaggtaattttaggttgtttttgtctgggatataaacccattgtgttattccagttatttggccaaaatgttccatgcaaccattttggagtgctagcactttagggaatttataaaaaggggtggtgttcagtgtctgggttgaatacaaggtaggtagaaaaggacaatcaaaggaattagctgcaaatgagatgaaatctatgggaacatatattgagaaaactagtgaccattataatttaatcctctgaaatacctgcaacaatctgagaacaaggtaggtggcaagatgcatttataaatattaaagaaacacaagaccccatacactttgaaaactggggagtaccgaacttggagaggtctagtataggtagtgcttgttggtttgcatatttttaaaaccactttattgaggtctgattgacatagaaaagtctgtccatgttgcatgtatgcaacttaatgagtctaaagataaatatatgcccatgaaagtatcaccataatctgtggcataaacatatccacctatttgtttattcttaattaaactttttcctgagataattgtaggttcacaggcacttgtgagaaataatacagaagtcccatgtaccctttactcatttgttctcatcagtaacatcttttataactatggtacaatattacgaccaggatatggacattaatataaccaatattattcacatttcccatttttcatatattcctatgtgtatatgtttagatccatatgattttattaaaattttatccaccacagccgagttgcagaaaagttccatccctacaaggacacctcaagctgcctttttataaccatgcccactgtctcccttcccctactgctgccacaggtgtccctaacttctggcaaccactcacttgtactctatttctaaaatttggtcttttcaaaatgttgtatacatgacatcacacaatatgtactcttttgggattgtttctttcttttttactcaacataattccgtggggattcattcaagttgttaagggcattgatagtccaccttattgcagcatagcattccacggtatgtgggtaccatggtttgtttaacccttcacccattgaaggacatctaggttaattctagttttgggttgtatcaaacacagttaaagcattcgtgtggatgtttttgttaacatacatattcgtttctctggaataaatgctcaagagtgcaatagcgtatggcagttgcatgtgtgtgttttaagaaactcatttccagagtggctgttccattttagaatcccaccagtgatgtatgagtgctccagattgtgcacatcctttgtagcatttaaaataaaggctacatttattttactatttaaaataacattttagccattctgatagataatatatcactgtggttttattttgcatttctttaatgactaatggtgttcagcatattttcatgtgcttatttaccattcatatgtccaattcggtgatgtctccccatgtcttctgcccattttctaatttgattgcttatttgtagcttgctgtttttattctttttacagggttttgctgagattgattaggtccaatttatcaatctttcctcttatgtattgtgttttccatgtcaagtctatgaagtcttgcctaaccctaaatcctgagtattttttctaaaagattttttttattttatattgttaaatttaagtatgtgtttcaggccaggcatggtggctcatgcctgtaatccccacacgtcaggatgctgaggtgggtgaattgcttgagcccaggacttcgagaccagcctgggcaccttgtctttacgaaaaattggctgggcatggtgctgtgtgtctgtagttccacctatgggggaggctgaggtgggagaatcagttgagctctggagtttgagaccagcctgggcaccttttctttacaaaacattggctgggcatggtgctgtgtgtctgtagttccacctatgggggaggctgaggtgggagaatcagttgagctctggagtttgagaccagcctgggcaacttggtgaaacctcgtctctactaaaaatacaaaaacaattagccaggcatagtggagtgcacctgtagtcccaactgctcaggagctgaggaaggaagatcacctgacctcaggaagttgaggctgctgtgagcagagatcatgccactgcactccagcctgggcaacagagtgagaccctgtcttaaaaaaaaaaaaaaaaaaaaagcctatgtttcactttgagttaatatttttttaaggtgtgagatttggttttgagcagtggatgtccaaatagcccttagttgaaaaggctatatccttccttcactgaattgctttggcacatttgtcaaaaattagtagaagatatttatgttgatttatttcagaattctatgtatatccttccaccaattccacatgttcttgagtactgtgagctataatatctagtagagcgactccttctactttatcctgctatttcaattacaaaaaataataaaccttttagggcctatgattttccatataaatttcacaataagcttgttgatgttttcaaaatatcttgtttagattttgataggaattgcattatatctatagatggatttggagtgatttgaaatcttttactatattgagtcctctaatatataaacatggtgtaagtatcaccatttaggtcctcttttattggcattttgtaatttttagcacatacattgtattagtctgttctcaccctgctataaagatactaccagagactgggtaatttataaagaaaagaggtttaattgacttggtttcacatggctggggaggcctcaggaaacttacaatcatggtggaaggtgaagggaaagcaaggaccttcctcacgtggcgtcaggagagagaagagtgaggtgtgaaggggaaagatccccttattaagccatcagatctcgtgagaactcactcactatcatgagaacagcatgtgggaaactgcccccatgatctaatcacctcccgccaggtgcctccctagacacgtggggattatggggattatacagttcaagatgatatttgggtggagacacagccaaactatatcatacatcctgcacctgttttgttgagcttacccataaagtgtttcattttctttttggtgattgtaattggttttgtgttttaaattttggcttctgcatgattattgttggtatatagcaatgttatgaattttctagggtgatcttgtatttcaaaactttgctgaactcacatttatagtagttctggaaattctttatttgttggaattttctacatagacaatcatgacatctgaatttggagcagtttttttaatctttccaatatgtagtttttatttctttttccttactgcagtgactagaatttttagtagtatgttgaataagaaaggtaagagcagagattcttgctcttcttgttcctaatcttaggaagaaaaagagttcaactttcaccattaagtatgatgttagctgtagattgtttgggtaagtgttctttatcaaattaatgaagttcctctctattcctaatttcttggagttttgagtattaaatattgtcacaaggcattttctgattcaattgatatgattatatgatttttcttctttagtctattaatgtggttgattacactgattgattttcaattgttgaaccaaccttacatacctgaaataaatcctacttggtcatagtatacaattatagtatatgtagtatacaattccttttatatagtgctgaattgatttgctcttctttctctagtttcttgaggtagaaacttaatgttttaagatccttcctcttttctcatataagtattagatttagcttagtgttgtaatttaatgtgtaatttaatttagtatttaatttagtttagtgcaataaatttccccttccacgctgctttagcagcatctgacatattttattatgttgtatgtttgactcttggacaaaatgagggcttggggtattgactcccgatggagttaaaaatttgcatttaacttttgaccaccccaaaatgtaactactaatagcctactgttgaatggaagccttaccaataagataaatggtccattaacacatattttgcatgttatatgttttacgtgctgtattcttataattaaatagagaaagaaaacattgttaagataattataaggaagataaatatatatttactattcattaagtgggagtggatcattatataagtcttcatgctcattattttcacattgagtaggctgaggaggaggagaaagaagggttggccttgttgtctcaggtggcaaaggcagaagaaaatttgtatataagtgaatctgtgtagttcaaacctgtgttgttcaaaggtcagctatattttcatgtgcattcagttctatgtttttgaaatttcctttgaggttttcaaaattttcttttacaactttctttttgactcatgggttatatagagatgtattgtttagtttcaaataaattggagattttaaatattataattctgttattgatttcaaatttgaatcattttcaatcagagaacacattcagtgtgaattcagttctttaacatttgttcaggattttttaacaggccagaatgtagtctatcttggtgaaagtttcacaagtatttgaaattaatgtgtatagtttgttttgtgtttacacacgcacacaaacacagatgcatacacatataaatcttctgttatctttttatttctatttaaagaacttcttttagtcattatttaagagtaggtgtgaagaaaaccaattctcttataaatagaactaagtacatctactttgtatacttttcttgagtgattctatattgtaatgatgtcctttttactagttctatcaattgctgagagtttgctgttgacgtccctgatttaattgtgggcttatctatttctcctttcagctgtatcagtcttgcttcatgcatgttaaagttctgttgttaggtgcatacatgtttaggatcattaggtctttctagtggagatatcattttatcattatgtaatgtccctcttaacctctagatatttggtttgttctgaaatctatgctatttgatagttactagttattccttttttcttttgattaatgtttgcagatatatttttctgattactaatttcaactgacctgtgttgatgtccatgaagtgaatgttgtacagatagcatattttttggatacttttttaaaaattaagtttatattctaatacactctgctaatctctgtcatttatttgtatatttagaccatttacatctgagattcttactgatatgctagccttatgtgtgcaattttattttttctatttcttgtctgttgtgggtctctgcatttctcttttctgaccttgctgtaggttacgtgaacacattttaggattctatcttggtgttttaacagcattttgggtatatcttttttgtatagtgtttttagtggctctaggtattaaagtatatgtaagtcacttatctactgacatggacatattactacttccattaaagtgtacttttatttccacttaggtcctttactcattctaccttttcagtataattgtcttaagtgtttcccctacatacagtgagcatcacattacactgagttgtaatttttgcttcaaccgtgaaatattatctagcaaactaataagagggaaagtctaacttatttccccctaattttattcattctgatattcttattttctttataagttctgaagcttttattatcattttgtttctatttaaagaacttcctttagtcatcctttaagaatgggtttgatgaaaacaaatactcttatttttcactcatctgagagtgtcttgatttttccttcattccgaaaggatatttttgctggatataaaatttatgattgacagttaattgctttcattacttgataaatgttgtgccactccttctggcttctaatttttcagatgagaaatctgttgtcatttgaactggtatttacttataagttttacatcattcctctggctgctttcaaggttttctctttgcttgttttgtatttagcagtttaatagtgaaagccctagcatgagtttccttggttttatcctattgtatgagatttgctcagcttcttgcatgtgtttgttaatgtcttttgccatattttcagtattttcagacattctttcttgaatacattttcactgccattctctcctcttattctaggattccagttatacaaatgttaactcttttgtttttaactcactggttcttgaagctctcttcaagtttttttttttccttttaatctctcttttcttatttgttcaaattaggtaaattcttttgatttccttcaggttcaggaatcctgtcatcttcctgttacccttgaacccatatagcaagtttgagtttgtttcaatggttgtatgtttcagttatttagtttccgtttggatcttttatatatatatatatatatataacttctatttctatgctggggtttctctcattttttttcttgcttgaaagaattcacaattgcttgttgatgcatttttattgtatctggtttaaaatccttgcctgataattccaacatatgattcatatcactgatggcatctgttgatcttcttctttcattcaagttgttattttgatggttcttagtatgacaagtgatttttattatatcctggatgttttgggtatcgtagtatgagactctggatccaaattcatcttctttttttattcagaagctgtccttacattgaggtgtgcacagaggccaggtgggtgtgtatgttcattcatcaccccgttgtcactgccaacatcatccagcagaagtggagcactgactcacactgcagcagatgggtagggtgaaacttcagcttccctgttgaccccttcccagtgaaagcgggccgcctattgctgctgccttgttgcccctcatggtgacatattcctaactccccactgagccacggaagggaaaaattcattgcttgttcacactactttgttgctgcagggtaggggtggaagctgagcttcctgctggtctctgtgacaccaggggaggtggggaatggagtgtcaagtaaccctcctcctatcaccttattctgcctcattgatgccaggtgtgagagaaggttctgcttctctccagaactctcccagttcttgtgaactgggtccaattcacaagaaagggaaaaaggatgtagagtattgattggccctaacacctagcacacagtctcactaataccactgggagtaggggctcagctcccctctaggccctgctcacttagtgagggtggggtgggaacagaatggagactaaccctgacacacaccacctcatgtggtcttgtgctgtgaagagagtggagaggttcattccctccttggtcccactgacaccagaggttggagtaaagtaaagtgctgatgagccctgactctcgtgtccttgtttagtcttgttaatattgggtggatgttgagcttcagctcctgactggggccctgccagagccggggggaatgtaatgtgctgactagtcctgccttgcaccacttcactaagtcttgctgctaccaggtaggggtggtggagatggtttagctacttgctgggctgaggtgacactaacttagtaaagagttggagcatggctgactcctttcagacaggggatgaaagatcagccctctgctcactctgccaatactatttagaaaagagaatcagagtggcacaacttccactgagcagaggacagaaaataagctccttatttggtctcatcaaaaccacccctacctacagttagacagctgcctgtttcaacaagtggagaatggaagatcagctctctgtttggtttattggaaccaccaggcaaggggaattggaacactgactgcttctgccagtgggaatagaaggttagctgcctcttggccctgtcaacaccactgtgaaagggaatcaaaaactactgcttacttctgttgggtgagagggtggggtgaaagattagctccctgatgagctcggctgctggaactatgaatgtgtgtgagtgtgtgtggggagagagtgtgtgtgtgtgtatgggtgtgcttgtgtgtgtgtgtttggtttttccattggagtttggctaaagtatgacaggtactttttgctaaaaaggttttctcttgtaggccaacattttcctgatcttctgtctaggaaaataagcctttccttggagcttattttgtctgtgcctgttggtggttctacgttagatgtttctggatattaaaacaacaacgaaaactagggaatttgccatgttgttcctcaagtcctcagattcctaattttttttcttctacctacttcgcaaagtcatcttacacttatttgttttgttatgttcagggctttttaattatagaaagagaactgggaggaataaggctgctccatctctgtcaggatcagaagtcatgtagtgttataaaaaggactttgtctaccattttaaaatagctgttggctgtaagctccttattgtatttaaagtatattggctaaaattgtgggaggtaaggaaaactctttgtaaagtgaactgacatggtgaaaagagagagaagatatgcttgtcaaatattgcgaagtctattcagatcaagctagacatggtctgtattagtcagggttctccagaagaaaagaaccaataggaggtgcatgtctgtgtgtgtatgaaaaggaatgtattagggagaatttgctcacatcattataaaggcaatgtcccacgacaggctgtcagcaagctatagaatgatagaagccactagtatgtctcccaaggaaggtgatactatgtctcagtccaagtcccaaagcttcaaaaccagggaagctgacagtgcatcccatagtctaaggctgaaagcctgagaacccccagatcccccagagaccactgctgcaagtttcagggtccaaaggctaaagaacctagagtctgatgtctaaaggcaggaggaagaaagggcattctgcactggaagagaaagagagaggcagctcacaaagcaagaaaagcctgcaagctgaatatcccccttcttctgtctgctttactgtagacacacctgcagctgattggatggtacccacctacattgagggtaggtctttctctcagtccactggcttatatgtcaatctcctctggaaacaccgcaatagatacatcaagaaacagtgctttaccagccatctaggtatccctcaatccagtcaaattaatattaaccatcacatggcctattcacaatttaaaaatgtagcataaattgcagcagtggtcaagtgtattggcaagttgtaaagtgcctataagaaacctatacacgagcatttgcagattcccttaacacttttcagcaaatattttgttacaattgaaattaaaaggcagtttgaaattgttcctctactaaatatcacactggatatgaataaaataactagatagactaacaaggtacatactttattgcctgtgattattgcaactaccactcctggtggagagccattcttctcaggtgtgcaagtggaagattaattctcaatcaggaatatagatttgatacaaggaaagcatttcacttggcattagtgtgtcaacatttcagctaatttgcctaaccacaaatacttcagggggaagagaaattgctagtgctttatattaaacattggatggagctggcggagataatacaatttgtactttttttacatagtttcaacgaattttggcagatatgtctttttgaggcaactttagatgttgaaaagctgcttgtggatattcaagacttgtctttttttcatgttacaatgaccatcaccatagtttgtatctgattttttttgtgtgaattgaggaatgtggagtcataatgcaaaagtcattgccataattctttgcagatcttatgactggaaattcttgtgtatgtagtttgatattcatttgtaacacatgtaactggttcgtgtaatgattaaaataataagtaatgcttgatcatggttaaaataaataccaaggataaattcttctattaattagtgtaagcttatcctaattaacatctttaattatgggctgttgttaatttttgtcgcaacctattagatatactgtcctaaatcattaacactagtgtaactgagcataaactctaggtgactcacggctacagtggaagcgcccatggaaaatatatatttctaagtacacagtttagataatttcaagcagaatcagaaaattcttgatgaattctaaatttagtataaacagaaatgtattaggtttggttattgagccaagcttcaaacattgaatatcagaattgtgtccatttgcaatgagtaagcatttgattcaagatttttttttgtactcagactcatttttgtatatctttctgtttaagtcatattgtatttactgcgattacagattttttacatatttcttaaactggttctatgttatgccattatataacaggtgataaggaatgtactgtcactgccccttgacaatgaaaaggggacatctctactagtgtatgtgtatgtagctgtggaggagttgaaacagtgtaagtgaaatgcctagaaattgtcctgagttttgattttgtttgtgcttacatttttattagtatatgtactttcttgaatagataattgatttggggcaatatttctcaatcttggcactactgacattttggactggataattattggttgtgcctggctttcctgtgcattgtaggatgttcagaagaatctctggtctctacccactagatgccagtagcaaacctgccacctctctgcctacttccgtcctgtcttgcaatagtcaaaaatgtctgcagacattgccaagtgtcccctaaggggcatgagccttggtggagagaaacttctttacagtctcatccttggcgatgtcatttccttataatttgcgtagttaaacatttttgttttgaggagcataagttgtgataccatacctgtacagaagaggcttggatttaaggttaaccacatttaactgagagaattttatcaaagcatgaaataagaaaaataggggcaaaaaatgaaattctaaaatggcttatgcaatttctaagggtagctaataagaattctgaattggtgacattgtttttaaaaaaagtaaagcattaaaagaatttcaaagataaaatatattttttggagtgtgaacactgtaattaaggagacccaataatgttaagttacttaaaggatgtatttttacttaaagtaggatacaagttggagaaattaacattcggttgattgttaaatattttgattcaaagaaagaacatagaattgtcagcctcaaaaaatatgcttaagatagaaaaataattttggttgcatgaaaagaaaaagattttagtaaattgttgacttgaaaaggggaactatttgacagaagtctcaacagtgttttggagtggcatagtgattggggggtgacatcagatgattagagttaaaaacgactggaccggctgggcgcggtggctcacgcctgtaatcccagcactttgggaggccgaggcggctggatcacaaggtcaggagagcgagaccatcctggctaacacggtgaaaacccgtctctactaaaaatacaaaaaattagccgggcgtggtggcgggcgcctgtagtcccagctacttgggaggctgaggcaggagaatggcgtgaacccgggaggcggagcttgcagtgagcggagatcgcgccactgcactccagcctgggcgacagagcgagactctgtctcaaaaaaaaaaaaaaaagactggaccagttattaggccttaagttgatgtaaactatatgacaaattgacaatttagagacattgtggggacatttctatgaaacgtctgtttattattcattcctgtgatgattttgaaagggcaaataaaatcataatcacatattgtataatgctttttgtctttcaaatacatatacattaaaaatgacttatataaagcaaaatgtacctttttgtgcacaattctattggtttttgtggatgtatactgttgcataaccaccatccaaccaatacacagaagagttctataacttcagaatattcctttgtgctactcttttatagtcattcccatcttcccatccccaccctctattgacccgtaaactgttttctgaataaatatctgggaaaaggattgctgtgccacatggtaggtgtatgtttaaagtttctcagaagttgacagactttttccacggtggctgtaccattttgccttctcaccagcaaaatgtcagattacagttgttttgcatcctggccagcacttggtatggccacttcatttatttatttagctcttcttctgataggtgtttagtggtatctcattatggttttaatttacacttctctaatgattgatgattttccccggtgactgatgatgattgaggatcttttcaggtgcttatttgcctcccatgtgtgtatcctctttagtgaaatgtttgttcaaatcttcccatttcaaaaaatgttggcccttttcttattatgaaatttctatggctctttatgtcttgtgcatagaagtcctctgtcaaacagatgtctgttttgcaaatattttcctgatttgtagcttgtcttctcaatattttaacagtgtcatttatagatcagaagtttccaattcttcaggtctggctcccctccataatctgtttgctttgattcacttttcagcatcctcatgtagttgctttttgtgtttggtctgagattttacttgtgattggcagggagagataggctgaacgtgactgagtggagtatagcatgagaagacttgcataatattttttttaattttcagtgttttgcaaacattatttttgatccattaataatgttaatgattgccattttatatacgagaaaataaaaaaatcaagagtcataagagtttaagttcataaataataaaaagccacatggaaataaccagtgatctaaatcacctggaacaactaaaaccttaaggtattatatcctagtttgtgtgttccgaccacaagcccctagaatgcaaattacttatgtaccttatttaattatgtttgctttacgtaattttagtactttaggaacttccttgattaaatttcaattcatacatttgctgaaaaataactaattttaaaactaagtaaggttattaagtaacttttttccatctggaggagaattgtttttgttccagattctttactgacacaatagtagcacactcgaataagtgcatagtatgcttcatggaagatcatgtgtaaaagccaggcttagtcaatgtttcttctgataatacatgtgaaaagttgaaaagaacctttatggtcattttcctagtaagcaagtcaattccttttgcttaaagcattttaacttcattaatgtaaaagacaatagatatctactatgtatacaacactttttaagagatcttgaggttacagaagatagtaaagccatggtgtctatccttaagaagctatacataataagaaagaaagaaatctcactgtgatattgagtatacatttttggaaagtaatttttgaataaaatcagatgttttaaaaaatcgtaaaaggttttgaatcaacattttcaaatatttagaaaataaatgagaaaaaagacagacccaaccaattccttccagtaattttgctctgatattaatgtaattcccttcagcttttatgtgcatattatatatgttattaaccatagtacatctttaaaacatatataattttgtctgctcacttttttttaaaaaaacagcattgtatcacagtttattttcatgtaccttcatagttcaaggtacaagggaagtaacagagattccctgagagaagacaatggatgttcctaagaaagacctagtgtgagagttcagggaactgctacactttggattttttttttttttttttttttttttgagacggagtcttgctctgtcatccaggctggagtgcagtggcacgatctcagctcactgcaagctctgcctcttggggtcatgccattctcctgcctcagcctcccgggactacaggcgcctgccaccatgcccggctaatttgttttgtatttttagtagagacagggtttcaccgtgttagtcaggatggtcgggatttcctgaccttgtgatccacctgcctcagcttcccaaagtgctgggattacaggtgtgagccaccacacctggccaggattggttttttaaaataatgtagaatgttttgtatttgtccttgcatcatgtaaagatttatccttaaaagtgcaatttgtctttggactataaactctgcgagggacaggacagtacttacatagcatgttaaaaattcaagtatcaatctacccatttaggtctattggctctttactgagtccagggttttatttacatgtatcactgaatgaatggccttaagaaggtacagatgagactactgaggcatagagagatttaacagaggcaagcagagcatcacaagcagtttggaactcaacacatgtttcttgtttgaaaatatgcacagacaaaagagggatggatagaaagttggttcaatataggattaagacctggaacaaaagcacatgggcaccagcagaatctacttgagaggtcacagcgcccaaggggaaacaaccctaggcaagtcacttaacctcactcaccttagttctcttgttggtaaaatgcagagtttatgcaaactcaatacatgtcaagaaatatctgcaaggcattgtttaaaattgaccctctggatttttttcatgcatgcctggttattatttattaagatgtactaggggcaagtctcaaatggaagaaaaaataaaaggcacatctgcaaagtgaagaagtggggttaagcgcaatgcaacagaaactcttatactaatccaggaggactttacctgtcaatcaaatctatattcattttttttaaagattaataatggtttgttaactgagtaagctggcagatggtaaagtaatgtgatgagatcttggggcatctatgaccagttgatgactgactgaccaatttcaaaagatgctatgaaggatcataaagtttagttccatgtggattttgatgatagttgcatctatatttaaagccttctgtcactggaagcactcttggtgttgtcagactgtctattggactggatgagctgcaacttctcgcaattgaatgtcaataagaccaaagcaattttggttgattcatagcaccagcttaagcatattcacttgcacagattacatttgacagatagttaccttcagctgaactctgtggttagaggcttgggcgtattcttgacagtgagcttagagttgatgtctaatgtttatttcatatcctgtttttaccttccctaatattgcatgtgtaaatctatatttaaatatattcacagctgatgttcttgtcggtccacttgttatctctggacagaatgctgtaatgattcaatttaattattttaataaaaataacttgcacccctccagttttaatttcaataaatctgacgagtaatgattaattttaaggagtcttattgatgagcaattgcaacactataatgcaggaaaatgcccaagtggtgggagcatgcttacatctatagtaaacttaaaaccttcaaaatttggtgtgtgattatgaacaccgaggaaatatatccacatttatttaccaaattattattcctgtatcttttttaagttatttaggtccatcagttatcttcaaagtttaggtttgaaactatccatttcaagaatattagccttttaagatgattataatttaaataacatattctaaaatgttttaattgaacagtagaatgcatgtaacccaaaacattataaaatttaaaaagtcacggccatttttgaatatttagattgggaaaacacttaagatgtggttttatgttcaagaagaggtgcaattatggtatggattcattcatcattatggtattgtattgtcaacttttcagttatgttcaatttttaagatgctgggtgggaaatttaagggacatatagatctaataatctgagcctaaatctcctgctctatacaaataactctgcaaagctttggaatccctttatttgactaggtgaatggcagttttgtttgcatcagcctaaacctagcttggaaatcatgattttaaagcaaacacgttttcctcacacatttccatatttcctagaatctatggttttaagatatcaaacaattcaaattatgtagttatacatttcacacaggacaaaaactcatgctgaagtaggtaaaatatttttcaaaattattttctctacatttactggcatactttctctttcttactgtcttttaaaactgacagtcagttttttttatttttctcttttactgacagctagtaaatgtactgacagttcagaagcaagatgtaaatgtaagtcactattattttgttcacctgatacctgagcattagtagaaatgcatggctatattttaaaataaaaactagattatttccaatggttctgaagggaagatgtatagaaaaactgtcctctgtaaataaaaatgtgtttgaggcaagattgcattacatttagaaatagcatactttcctcattaggatgtgattggtatttgtactgaagaaaatgggctaattatttaagtaagatgtatatttactttctgtttcattagctgtaaatctttatagcatataaatctcctttagaaattaatgggaagtatataagtgagggaaagaaagcaggttatgaagttaataaataccatgttaaaaattagtttctacttaaatataaagttcaagattaaaaattaaaaattgttttattttaattagaaaaatcttgcttagttaatttctctggaagaaatgctatataagcagttaaatgtggagaattatattctattgataaaagtatgttgggccagactgaaccaacaacatcatagaaggactgattccttacttcctttaaaaagtgatctgtcatttgtctacattataaataacagctgagttttaaaacacaaggagatttttaaaaagtggcagcatttatttatttactgcttagacagtattcacagtattttatttcatccttaagactctttttttgttttgctcccacattattgttacacatatgggaattggtaaagtgggaaaacttagcatttatagatttttatactgaagcatgcgatgataaagtagtcactttcatccaagaaccttttcctcttttcacttacactagctcttccagaaatggcccctttagtgcctttaatggttttattctccttctgtcactatttttaatattcttattcttatactgccatcatatataactttgtgaaaatttgtcatataaggttaaaattgatttgcctttaaatacagtagtttccattttctgttaactgtttgaagaacacctattgagaggcaaggaaagacctgcgggataagttacaaaaggcaagaattcctcacagaaaaagcagcaggagcttccttgtcaagagcttcagcaagtagtgtcagcagcttagaagttgctattggactgctgagtgttatgcagataaattgtggctctagcttgtcctccgatgtcattctttgatttttctctgttaacactgcatttgcatttgggtctcactgagaacaaggaccagtgcaaatgccttatggcatgtgtagaaagctgcttttatgttaaaagtgatatgttttcttgttcactgtgttcacaacaaaaattcatcttccgagtcttggaattcccttatgtatttgtaattttccttccaagtcataatattcatatacaaagagtggaaatttttctttaaaaaaacctaccaaacaacaaaaacagtaaagttagttggttactagcagcaacaactgaaaagcagcatcaccaaaacatatgcaattcatgggtttccagcaaaagaggaaatctggaaagagaagatccttaagtattgctttaaagtgagcactgaaggacagccgttaaaacaatcccaatttttagaaaaggtattattccctgacatttacttgttttattcccttctcaatctgaagacacattttggacagatgctcttgtcttacatgaacattcaattcatttgagaaaataatggttatacttaaactcgtgaagtgaaatgtatggaagtctgttgctttataactttaaatagccatgtaacttgttcatggcagaatatagtcaagtcctgggcaaggactttttttctcttctccaataatgctattcaaggggaagctagttattgtgtgacacatgcttgattctcaggaggtttggacaaaagagagggttagaaggtcaggagagcctgacgctattcaactagatatttgagtagaattcccacaccagaattttgcctcatacctaattcagacagtgtaataatgggggaagggcagagagagggagggcagatggaggtgtcctttcaggttaaatgttaaaataagggtcttcatttctgtctctggtggcacagagcattaaaaaccctgtgacacattttggaagtgttgctataaaatagattttaacgtttgaggatctataaagggtattattgagtacttaatagattctgtgtttgcctactgaaatcactacaccgccgatatatacctcattaatttgtaaagcagtttggcccaacttgagacaatgtactgtattaaagcaaagtctatatcccaaattttcatggctaataattacaaaacgttcagcatctgaagaaaattatctaaatgtgacaatattggtcttggatagtttaacttgcgtgaaatatttcacacagaaacatttgatctatattgaagagttgtttcttttttcatcagatcagctatatcacagtaaattgtggaaatagaaaatggaaactaaattgttgaaaatgcatctgatagtttgtttttattgccaaaatgtcattgtccttgaggtccatcactttgtagcttagtaaaaacagatttaggcattgcaagtgagaagtcattgactgttttccttgtaaccaatttatttatcaagttggtaagtttcagaagtatttccagtgttcagcctatttcttcacttttctattttccaaattatatcctattacttcaaagatgtataaagttcacacattctggattctttatctcttttattgttttctgcttcatacaaagtaattaaattatgttcttgaagtaattcctcctatcttacttaaaatcaccttcatgatctgtcaagagttttcaagttgttctgtgataaagttcttagagtttgagaagctaaatggtggagttggtgcttaagctcttcactgaaagctgcaagagtataaacgaagtcagaaattactattattattatttttttctcattgagacggagtctcactctgtcgcccaggctggattgcagtggcgtgatctcagctcacggcaagctccgcctcccgggttcgctccattatcctgcctcagcctcccgagtggctgggactacaggtgcccgtcaccacgccaggctaattttttgtatttttagtagagacggggtttcactgtgttagccaggatggtctcgatctcctgaccttgtgatctgcctacctcagcctcccaaagtcccaaagtgctgagattacaggcatgagacaccacacccagcatatatatatatatatatatatatagttttttggtttttgttttttgtttgtttgtttgtttgtttgtttgtttgtttttttgagacgagtctcgctctgtcgcccaggctggagtgcagtggcaggatctcggctcactgcaagctctgcctcccgggttcatgcctcagcctcccgagtagcttggactacaggcgcccgccaccacgaccagcaaattttttgtatttttagtagagatggggtttcaccgtgttagccaggatggtctcaatctcctgaccttgtgatccgcctgccttagcctcccaaagtgctgggattacaggcatgagccactgcacccggcctgaaatgactattctttttaataacttctatttattgttttgtgttattcataattgttgtgcaatttaatttatttcactagtagaacactatgtacaggactgtactgtgtggaggttttagaagtgacaaaaccagttaactaggctcttggtccaaaggaatttagtgaaagagataagacataaacactaatgactgtaacatttatggaataataaataggagctgctgaaagttgtgatttcttctcattatgatagtgcttcttggattataaaaaatttaacctagaacatgaggtttcaagaggcagagatggggagagaagaattccaggtttgggactaggatgtagaaaggcagaaaggtgaaaatattcttgtgatgatggcaaacagtgactggtcaagtttgccaagagtaggttttatgcaagagcgtagtaagatgaaaccctgaaggaattttactgtcagatgatagaaaccggaataaagctgaggatacagttcaataatcaaagggaaccaaatgaaagttttgagcaaagaagggatcttattaaaacagccttttattatttcttttaagctagaggtagcttggcattatctgtgccagctcagagtgaccttcaccccaaaattctagttggattatggagcagttaatcttacaggctctaataattctgtcaccctttgttgtcattctatatctgtgtcccttcagttatgtgtcttctcccatattctcataccattatttctctgtctttcatttctttactttcatcatccacatcaggacaatgtttttattctatagtagtttgtaaacatgtcacattctttagactttcaagctctttgtcaacagtttttcaaagtccttgccttacataaacactaattctttccctttagggacccctttcctggcccttccaagcaaagggtgctcattcatccactcctcatgcacctcattgctgggagcaagtagagatgtagggattgctttcttctttttcttttacctcatattggaaagagatgtttcctttaaagctcatgttaagttgttgtgtacctttcttcaatttttgcatcaatttttgcaaaccttgcatcaatttttgcagctgctgacaccttggataccccagccacctgcctgccagatacaatgaaaaatttcacctctgactcacagtgtttctctgcatcattatcagcttttggttaatgaccatgaagcttcactttttcacctcttgaaaacttttggctacagaatgaagttaagcgcctaggtgcttatattgtctttgagtctgttgggttccttctaggttcagtttcttcacttctagcctagcccacaaggaaaatatctttagtagtcttttaaccattttcttttatttcattttttttcattctgttgccaccagacacctattctcaaatcattcacctgactgccttcttaattcctgtgtatagattgcagaatattactgaaaaaaaacaggtgtgtggattgaggccactaaaaattaatgatttccaactagagatggacccttagtgcagccttagggtaaatttcagaggtgcagctgattcaaagggtgtgcacaatttcaggggtatattgacctactgtcttcagaaaatgtttgactagtgcagactcctaccgaaagagaatcagagtgcctattcctcaaattattgttaatataaggaattatcttttctcatttttttctaattttatgggcaaaatagtatgagtgtattcttatttcatttagcatttcttcccctacctcgtacttatcttaccttacataggcttattagccagccacatgtattttttgcttctgggtaatagctgtgtattgttctcttatttttttaaataaaggggtctgcatttttattaatgactaagaaatcttgatatatttagaaattatatgtaaaaataattttaaattttttttattctactttaagttctggggtacacatgcagaacttgcaggtttatgtcatagttataaaaaaagaaagaaagcataggcagagaaggaaaatcactctggacagaaaaaaataattggttaaaatattaaagaataaaatttgtaggtaaaaataataaattttaaaatgacagtttaaaaatttatatgtaggctgggtgtggtgccccatgccgatagtcccagcactttgggaggcctacgcaggaggatcacttgagtccaggatttcaaggccaggttgggcaacatagcaagacgtcatctctacaaaaaaaaaaaaaaagaaagaaagaaagaaagaaaaaaaattagccaggcatggtggtgcatgcctgtagtcccagctactcagaaggctaagatgggaagatcttctgagcctgggaggtcaaggctgtgagccatggtcgtgccactgcactccagcctaggcaacagagccagatcctctcgcaaaacaaacaaacaaacaaattacatgtgaaaagaattatacgtgaagataataatttcagacatacaatcctatgttaactcccatagaaaattaagggagttatcacacctttgcttttaacaattctttctcttcccacattccagttttgttgaaataagcagagcttcttatcccagcttattgtagcaaaatcattatagtaaaatgatatttttatttcaagcattacaatagcactttataacttatttaaaaatttatatgatgttaaaaggattcaatactcattgagtatcctttcataacatacatctctaatttcttaatttgaattgagctttctatttggtgagagtatttctattctgaaaaggaacatggccagtgatgtaccttctgaatctttgcgtagttgagcctgtctttctaatgcctgtacccatgaacaatgtctggatgatgatggatttttttttcttataccctttcgtttgtgagcttttaatacattgcatcgtgtttctgaagagaaatctgagacaagcttaaggattatttttcactgtgggtgacccgtttttgtgtgcctgagtgagattcttacaggtttctttctttatccttaaaatcccaggactaccagcctatagtttggtgttaattaatctttgttttcttgagaatatggtaagcttttcttagctgaatattcaggtcatatttttaatcccttaattttggtttctatcatgtctttgagtttatattttcattatttgttttcttcgggctttcatcctgtgaaatttagtgaccaatatagttttattccttttatgtccaagatacataagaagttgtatgtactctagtgtccattcgttcatcaacttattccaattaccccaaacccctatttccaagggcttttcttcttccgttcagactctttatttgggtcttttcgtggttccttgcttaacactatgcacttttcacggcacacactttccctgggaattcttactcacaaccatgactcctagtactattttcatatgcatagttataaaacctgtaatttctaaatttatattgccacagtgctatcagtgagctttcaaaattcaaattcaagtatgatttttcttagttttaagatttcttcagttggaatggagacccttaatgacttagctctgacaactgttcagcctcatgttctgtaaggtctcctctgggacctcacattctagtaacactgagctgtctagtctttaattgtatccatctttcttatgttgctacaactgcacatgttctttaccaagaatactctcccttactatttattccgcttaatcctactttttcctttcactcatttggcatcaacattttcaggaagccttttcttatctcaaaatctgagtagacatgcactcatcctttctatgaaattatcgcaatttactcaatgtgctttatttgtgtccatcactagactccagaacttttagatcaagaattttaccttatttagtgttgttcccttcagggctcggcatcatgtttgaatgtgatccattctcaataaacaaagtttgattgaatgagtgatggcatcatccagtattagaacaaagttgataggacagtttgtttagaagctcttgcaagaatacagttgacccatgaactacaaggaattgaattgcccaggtctgcttttatgtgaattttttcgagctaaacacagattgaaaatacagtacttgcaggatgtaaaatccgactatgcacagggccgactttttgtatccctgggctccgcaaggctaactgcgagacttgggtatgattagattttggttatttatgcctggatcctggaaccaatcccttgaagactgtacagatgagagatattagttgatcgaatatgtagcaggagaaaactgaaaaaggaaaagaaatttatgaagtaaattaatgagaccgctgcatttcattactactttggagattagaggaacaataaaggtgactttaaaattttgaaccaacttctttataacatggcttacaagtggtagctagaaagaggagggttggttacttttgctttgtatattgcaatacatttctgattgttccctttccacttttccccctagtattgttgattactttgtctttgtaaaaaacttcatcgtgaaaatttctttctaaaatgtaaatgtgattacctccttcctctccttaaataaacactatgctcacgattgctcacactccagagaatgaaatttccttcccttagcaacatgttcaagatccttcaaaatttgttagatggtgcctctatagcttcattgtccttctatgtactttgagttttaaccatgatatttttttgcctcccaaaatcatgtactttgtggttttcatgcaagctcttcctgtttgccttattcagttgcttctagcttgtacacttttccctctccctcttcaactccatttctttgtgtacgtatctcaatgaccaccacaaatacaacttcctctgtaaaacacactaatttcttctctccttttctcctctctgctcctatagcacttttttttcttattggctgtatgacatttattacataggcatattttattagatattaagtaggttttgcattaggtatatttttgaatgtactgaaaggcagatactttattcattcatatgtgctcagaagagcaaaatatctcttacataatgtatgtttaatataagtaaatatacaaacaaatagaaatattgagtttggtaaaagatgatattgagaaaaagtgatatgtgatagaatgaaaagctacatatattttctaaatgatgggtggacatttacaactttgctaaattatatattaaatcatctctttatcctgaaaaaattatcttttccatgattagtaagtactttacagtctcttctaggttataaagctcagtactctaattagttttagaaaaactgtgactaaactagcagtactgttttttctcccatattttgtctcacactgaagtcagtgatatttttttctgttcacagatatattcactcttagccttccctgagctctattacagcctggaaaataactggaatttcctttaaaataatacacattttcttaacttatcatattaaatgaaaaacacacaaacactggcctcctttcacattccctagaactttttgttttttctgtatttggcatttctgatgtctttaattttttgtgattctggctctgtattctggtgcctggaacagtgttgcttccaaataaataggcagtagtgatagcaatactcataaatattttaagctatttggaaaaagatattttttagaagctgtgttttgaatgaccttcccatttaactacagtgaatttcattcttagttccttcccaatatctaccctcttgcatcttcttttatgttgtttctaacgtcttttgcggtacctatcaatttactgtcatctactgttttcattaagattgctacttgtagatcattaataaaaaggtgaaataaaactaaattccttatcaattctctccttaagtcaataagtatccagttttaaatgacagtgcttgaattcaagttcatattaaatgttacttcaaataagtttgggagtttacacatacatggctctttggttcaattacatttgtcttatttattttgttttctgttcccttgtagtattctttgataaacttgtcctttaaaatatatattccaactaaactctgcttagggcctaagtggtgtagccctctggggagggtcgcaaatgtaatttgtttgattggatactcaagcttttcaattgttttcttttccttagagaaatagaacctttctagctttcaggtcaattgatgtaatggttggattcagatggaatgacactttctccccattgtaagtctctagttcctcagagaaatccttgggaaatctgttgacaacttgctgtcatccagctgttctgatggtataaatgacttagacactgattcctggtagtttaaaagtctaatggaacagtgaaattttgagatctcaagtgcatcatgaataaagcacttaagtagcacttgtatatacttcttacaatttgttaactggttttctgctttttttttttgctggagaaagagatttacagttttaatctgattagacattagcagctggttgaagatgctattactgtgaagtatggaaaagaacacaatcatgatgaaaactttttactcaaatccttagaagaagaaagcagatgaaattagattggcaaaggaaaccagcccaaattacacacaggagagaaatgtagcagaggagagtactgagttggtgctgcacgcatagagcttacagcctccatgggcaggggacatgtgggtgtgactgccagggacaggaattgcaaacagcatttggagtgacagtctgggtcagcttctcatgctctttcccatcaccaggcatcagcgagtggaaagatttgacctgattttggagcacagagtgtgggctctaaggccacaggaaggcaggtgaatgggactaggatgtagtggagtccccatggctaaaaaataagttgtattgcatacctgcctttgccccacaattatcaaatccaatctagggtgaatagaaacacatctgcagacagatccaatgtccacctacaaaaagtttcagaaaatgaaaacagatggagaaaaaaaattataaaaatataaagaattctggtaaagttgccaaaagaaatgagtcttctagtcaaatgggctttgttctattagtagatgttgagacgaatgcagtgaattgattagagctgatgttatttgtttgggtgcatacatgtgtgcctggtgaggggtgggtgagggaagaaaaaaaactcaaacaaataagaaacatattgagagaaaaataatacctagagaattaaaatagtacactataacaaagtttgtgagtgattattaaggcttgtgtgggtattcgggggctctctgaggtgtcaatatgtaaactgagatctgacagtaaagactcagctaccttatatctcttcatccctacatcttgttctaagaaaacatcagaagtcctgtgatctcagcataagttgaaaactcgtaagtagtcattcaaaggtggatttgtggagggtagaggtaaactaccttgattatatttacatagaatggaagtgatgctaatttagaaatgtccattgctgtaagtcttaggagatgtaaagtaccaatgaaagatcctgaacagtattatgtgacagaaaatgagcgttacacttttaaaaaaatattagatgttgtaactttagtcattctcacctttaccttttaagtatttcaccatttaatatcaaccttcattattgatttatttctaaagatatctggaaatagtttaggctcattaattttctttttaagagtcaaatcggcatgcaaatgtttctcccaccaagaaatttttttcctggacttcaccttctgaggcatgtccacctttgaggcaagctaagccaggctttgtgaaggcagaaccatccgaagcacacagccccaccaaatttctctccctccttccctccctcccctgttcctctctccttctctttcttttttctctttctttctctttctttctctttctttcttccttccttcctttctttctttccttctttctttctttctttctttctttctttctttctttctttctttctttctttctttctttttatttctttccttctctttctttctttttatttctttccttctctttctttctttcttttttttttctttctctttcttctctcttcccccctcccctgctctcccctgctctcccctccccttccctttctttcagctgctgcttacctggggtaacatggtttgggaagaaacatgtcagaattggagtgaataaatataaatgataaaaagacaaaatgaatattattttcaagagtaattaccagtatgaagttcttcagatgataacaaaaactattgacttattttgtctaaatcaatgccactatcttatctgtgtgattgtgaagggaggaaaggaaactgttcactgaatattctgcatttgacccgtaaatacctacttttgtattcagggatgatatattcttaccttaaattaatgactgttttctactgttcttttttggtgcaaacaaattaaatgtgtgcacttctccatgactgattgtgcaaaaactgcttagacaattactatctctctagcttttgatcagaaaggactaccttgaaacaatggccacaataatggtattattctcaattctagaatttatttaaacaaacaattcaaatcatatttcataatacagttctctgaaggagcttaaagagattcagatttttccttttgtttaacatggctcttcatttagtttttgaggcatatttttaataaattttgctcagtactgtctactggagctgaaaaaatctaagaagacacaaaatggctgaagcataggtacttacagaaaagcatgcctttcttttaagaatataaaattaatacattatttatttattatataatgggatgttctacccttgttgaagattttagcagatataactcatgcacagtgtaagtgagcattcacccctgttttgtttatatggcaggactatttctacaaattttacaaattactgtttaggatctttatgacatccattgagtgctggcatgataaatgattttctatatatctgtctacatattgagggcctgattgatggcccttctgacttggggtcagcagtgagttcacatctcttggtatactttggcttattccctggaagtataaacagaaatccaatgaccactattttcattattttccttcaggcataatctgacctaatgatatgtaactgtattactgtgatttaagagatttttaaaaaactataaacattttgaggaaaagtgaaaatggtgattttaaatttaacacatttaaatattcattttatgaaaagaatatttgaaagaatagggatttatcaggatcaatagaaggcttggagtaacctaatcattttaaattttattccttcttgtttttttctgttttcccacaacttattcactaccctctatattctcatactttgctaaatcatattaatccttcaagagttggtttagatgaagcttcattcatttgataaagattaaatgagtgtccagtagttgctagctcaccttgttctgttgtgcttcacagacaatgtgttttatttttatttttattttatttttttacaaagtgaaggtttatggcaaccttgcttcaggcaaacatgtcatatattagtgctatttttccaacagcatgtgctcgttttgtgtatgcttcacattttggcaattctcacagaaatttaaatttttttccaatcattatagctgttatggtggtctgtgatcagtgatttttgatgttattataatttcagggggtgccatgaaccacaccaatatgatatggcaaagttaaccaataaatgttgtgtgtgttatgacttctccaccgacagaatgttcttctgacttgttccttctccttgggcctccctgttccctgagacacaacaatattgaaattaaattagaccgagtaataaccctacagtggcctctcagtgttcaagtgaaaggaagagtaacatttctctcacttgaaatcaaaagctagaaatgagtaagcttagtgaggaaggcatgtagaaagttgacaggttgaaagctagtcctcttgcaccaaacagccaagttgaatgcaaaggaaaatttcttgagggaaaattaaagtgctactctaatgaccacaaaaatgataaaaactgaaacagctttattgctgatgtggagaaaatttgagtggtctggatagaagatcagaccagctacaatattctcttaaaccaaagtctaatccagacaaggccctaactattccattatgtgaaggctgagagaagtgagcaagctacaaaagaaaagttggaagctagcagagattggttcacaaggtttaaggaaagaagtagtttccataacataaaagtgcaaggttgaaagagcaagtgctgttgtagaagttgcaagttatccagaagatctagataagatcactgatgaaggtggctacactaaacaacataatttcaatgtggatgaaaaagtcttctgttggaagaagatgccacctaggactttcatagctagagaagagaaatcaatgcctagtttcaaagctccaaaaataagactgagtctcttgttaggggctaatgcagttggggactttactgcacaggtggtaggtgccctaacccccatattgttaaagggtcaatggtttatagaaataatatagaagtaagtgtgtgattctatctaatctatctatctagtagtatctgtctatattcatattccctatatatccatagtccctacagccatccactgaggggagagagtgggcctgggagtagtaacactgaaatagcacgaatctacttagcaccgaatctttgttcctaaagaccactcatctcttagaggaaccaggattccttggagaaatggctgattccagggctgtggtggggaagtacaaaatgagcctagaacatcttgtgtcataaagtaagaagatacttaaagaattattagaacatgtcaatatgatccagaatgcagctgtatggggtctatactgtccaaacctggaacaacttgagcactgaaatacatattgagagtaattaattatatcccactgagtaaaatagagactcatgagtctatatagataaaaataagcctaagcatatattgaatttttaataagcaataggatatttatacagtcttgaagtatctgctcgcaaaatgtttgctaattgcaaaggggaaaattgtatttttacagtgtggaagcctggcagatatattaatgcaaatgattaaagttaacatcattaataatggaacaaatagaaatgatgtaagacatgataagatataatatgatcactgtatcacctgaatttaatcatgaggaaaaattagacaaacccaaattgagaggcaatctacaaaataactgggcggtcctctttaacagtattaagatcagaaaagccaaggaaagattgaagaactctttttttttttgggtcggcactgcttttttattttattttattattattatactttaagttttagggtacatgtgcacaatgtgcaggcttgttacatatgtatacacgtgccatgttggtgtgctgcacccatcaactcatgatttagcattaggtatatctctcaatgctatccctcccccctccccccaccccacaaaagtccccagtgtgtgatgttccccttcctgtgtccatgcgttctcattgttcaattcccacctatgagtgagaacatgcagtgtttggttttttgtccttgcgatagtttgctgagaatgatggtttccagtttcatccacgttcctacaaaggacatgaactcatcagtttttatggctgcatagtattccatggtgtatatgtgccacattttcttaatccagtctatcggtgttggacatttgggttggttctaaatctttgctattgtgaatagggccgcaataaacatacgtgtctctttcagatcaaaagaaaacttagagtcatgacaactaaaggcaacatgtgatttggggctggaggtgttttttctataaaagactttttggggtcattgacaaaacttgaatgggctttaaagataaaatggtaatgatatacgaataactttgatgtttacatcgtgcttatgtaaaagaatgtctttttgtagcaaatacacgttgcggtattcagggggaatgggtcattaggtcaaaaatttaatctcaaatgggtcagaaaaaattctttgtactactcttgtgactttcctgtaacgttgagatagttattttttaaagtaataaaaaacagaaactactgattgagctgcattacagatagaatgggaaaagagaaaatggacagaggaagtacaaacaacttacttgaggaacacctcaatagagagaagaagagtaacagggaaatatttggtggaggagacttccaagatattttcacgttctcatctttgttcctaaccactttattcatatttatttattatattgcctcctttcattgaaagtattttatacgccatttctattacagattgtaaattccttgaagaaaaggtctgtgctttatataccccttatgtgtagtatatgtagcatcacacttagcatatcataatgtgcttgtttcatattcaaacaacaggaccattttcaaacaagtgattggattttagtgagagtatgaagagcagttttctttataaacatgggagacaaaagaggttgactcacttttaaggagaggacattgtagttataacaagtaacttctagctcattgggatgtaacatgctgaaaaagttttctaaggtattttacagctaacttgataatcttttggaaatcatctgttctccatgagtaaaatagaaaaaggcacaatgatatattgaaataattaagagtatctaatattgtgatgaagtgtgcaccaaaagctttcttaaatgtagaagtgtacatgacacctctttaagcagtatctacaaaaaaccagctggaactctccctattccttaggaattcaataaatcagactgttggcagattttccatcatgtatatgtgtaaattaatagcttttttttggcagtagagagaagagagtaatctaaatgtgtaggaagaagaggccatgagagtttcacatccagtcaagataggacaaaaaaaaatctacttgcattcctatgttaaatttttaaagatcaattaaatggagacttgtttggtggaggttgcagtatatgaagagctttaatagagatgaggggagaacagcaaatccagagaatcatacccagggcacaaatgtaatacacgtaggctttttctgtagattgcttcaagagcctggcttggcttgtctgagttactcagagaggaaaaaatgaaagtgagtgtatatgttggtttggggtgtgtgaaggtgtgggaatggagagaagtggacagagggaaaatgtgttgaaataaaacaccaggagctcatggaaaatgcaaaacagaaacaaaaccaagaaaaaatctttgaggggcatacctgtgtatgaattcatttttccatagcacctttaacatagtcaaaacaaataaaatttaagcagttattcagtcaaactagtagcaggtgcacacacacattccaaacattacaaatatttgtgggccacccacctggttaatttctgccaaagcaactatccctgaataatttcctcaagtacttattcatattgtttgtataaacgtcactcaatagagaatatttaataaactggagcatttataattatataaaaattcatgtcagtaaacaaggccactctgaaaagttatgtgaagaatcacagtatgacacattttgttagaaaacggtgccttttctttattgcttagagttgtaacatcacatagttcatgttgttgttttcattttcggggtatcaattagttgatcaatcagttagtgtttattaagcttctgtccagcaggtaaagcatgctcatcaaatttgcaaatgacataaatgttagagggatggtaaaggcactgcatgacagacatagcatccaaaaagattttgacagctcggagcaataggctgaatctaacaagatgaaatataacatagataaatataaatgcctacctttgggtccacaaagccaactgtacatgtatagcattgagtagatgtgaattagctgttgatgtaagcaggaaaaaaaagacagtattttagttaatagtcagctcaacttaatttatcagttttagctgcatgatgtcattgccaaaaatctagcctgcaattttgaattgtattaaggtgacaatcctgtaccagtttgacaggtcagaccacatctagagattgtagtatttctggagccacattttaagaagagagacactaaaaactatgtcatatttagaacatcacagaaactaaacacatttatcctgaagaagacttaggagaggaatgacatccttctttacatttatgtaagctctcacatggaaaagggattaaatttgtttggtgcagtctcaataattagaactggaacttgtgaactgaagttataaggagatacctttgggttcaatcatttataataattacatataatagtaaaagctgttcagagagaaaggcgttcccaaaatctgcagaggcagaatactagcacagtttagcctgagtgtcctcctttgcaaagtggggacaacaccattgtgaagcagcgatctgggaaggcagtgggatgatatagggaaaatgttcagcacaatgaggggcatgtagtaagtaagtggttatagtacacaggggatgtcacctttcctattgtgggaggtggtgacaccaatcctgaatcatcactgggtagaggtatagaagagatgctaaatggatggatttgacaaactgactgttacttcaaaaccctaactgactgcaacttattaattaaatttgccatttaaaactgtctctgaaaccaccagtcacgcttctatagcaccttgagtatttttttttttttttttttttttttgagacagagtctggctctgttccccaagctggagtgcagtggcgcgatctcggctcaccacaacctccgcctcccgggtttagcaactctctgcttcagcctcccgagtagcccggattacaggctcgtgccaccatacccagctaatttttgtatttttagcagggacagggtttcaccatcttggccaggctggttttgaactctttacctctttacctacctcgtgatccacttacctctgcctcccaaactgctaggaatacaggcgtgagccaccgcaccaagctattctttttttcttttttttctttttttggatagagtctcactctgtcgcccaggctggagtgcagtggcgtgatgtcggctcaccgcaacctccacctccccggttcaagtaattatcctgcctcagcctcccaagtagctgtaattacaggaatgcaccaccacaactggctaatttttttgtatttttagtagagacggagtttcgccatgttggccaggctggtctagaacttttcacctcaagtgatccgcccacctcggcctcccaaagtgctgggattacaggcacgcgccattgtgcctggccaaatttttgttttcaatcctctgtgcttatttttaattatctttaaaatggagaaaaaggtaaacctgccttaggtaactgtaaagttaaaaagaatgaatatgcataaatattttagaacaatgtctgacatactttttttttttttttttttttggcagagtctcactctgtcacccaggctgtagtgcaatggcgccatcttggctcactgcaacctctgcctcccgggttcaaaagattctcccgcctcagcctcccgagtagctgggactacaggtgtgtgccaccacacccagctaatttttgtatatatatatattttttaagtacagacggggtttcactatgttggccaggctggtctcaaactcctgacctcatgatctgcctgcctcagcctcccaaagttctaggattagaggtgtgagcctccatgcccggcccatactagctttttaatatatgttaactacttttgtaatgccaaagtaggtggcaaaggattattggagaagagaggacttgagatgtgtgttttgaaaaatactaaaaatttagttaagtgcctatatggaaatagcttgaacacatcatgagattaagtggtgtgtgatcgtcagacagtgaggagactttaccagttagattggaggtcggctgttggtgaaggttagaaataaattgggtgagatgagtgaggaaaaatctcagaaggccttaggtttaggatggtaagcaataggatgggatgtgtggggattccacgtgttcgtaggtaggggaatacaacatacatgtgatttttaaaataaacttatagagttttcaggatacattgccttactttagcttaaaaattatggatggaatagtggaatctttttatgcaaatccttctttcacttagaaatagaaatttctatttcagggcaatttctatttcagaaagtccaagacttttctcctccataaagttttctcttctgattcatattacagtggttttctttttgtttgaatttcttagcattcaaaatgatgttccttatatttgtatcatccatcatgatcttttaaggggaaatttaaatttaagatacgttgtcaaatcgcttaatgttaatctattagaaaggtgttattctgaatgcataaaatggttttgctttaaatgaggccctccaaattaataaaactgctcttcctgggaagcttctaagttggttctgggaaagcaagtcacacagagaaggtccaaaaatacgttatacaccacatatattaacaaattaagacataatttctcaaagcaactccttggaaaagataatccttcttgactgcattaagattcagtatttaagttagaaacaaccatcatcatttatagtgattcaaacactatctagcatattaaaatgtattttgttgtcatcatacatacaagctccttgagagaaaggatcatgacttaactcttgttggtgtagctcatagggccactgtgggtaccgagttgatgctttatgaattcagtttaaattagaagaatgtaggcaatgggattaccatttgtccagtaacaaattcagcacaggtattctgtctctctatttcccagcctgagtcagcagtttcttttagttctgatggccagcaggagtaaaatagcagcaaagatctggcatttcagtggcacaggtgattgtggaaaattactataatctaggtggactcgattctattttccccttgctaggtactgagatattgtgtaactttctggacttttgaattatacttctcactaatctagcatgagaatgggtggatagtgtcaagaattctacttaaaaaaaaaaaaatctagtgtactcttgtactcaaagggatgagtacaatctatcacagggacacaaatgtgaccaaaaaagtggttaaaataaaatatgaaactgaagagaatgaagatttgagcatgaccttctctgtatcttctttccaaagtgttttcggatctcttatgaaggggatttaaaggcttttctacaactgctactgcttttgtcaattcattcattcaagacacaccaataaacatgcacgagctcctcttgtcctcatagggctagagaatgagataggtgcaaagtttattttagcagaaggctttcttttcacaaatcagaaattccattgtatgtattcccttaaataactggcaaggggaccatcggaatgagctatggcaaaaatccacctcagtctttacagcttcagggtgatggggccccagatcagaattgtaaaatagtttagagaatcttggaacataaaacatggtgcagaaaaaccaaggaagatttaatcttatgtatggaaaggtggttggtagtggagggggcaatggaagagagtggcttgggatcatcattaatcattatttaagtacctataaagtgaaaatatccttctggaattcactgcaagtgacactgaattcttctactaagcaaatatgtgatgagttgataaaaaagaaggtcctgaactcttgacaacagatataatacagtgaatacagaaaatcaaaaacatgctttctatctgactcaaaataaaggtgcacttaaacttgtaaaagacaacatttttatttgaatgatatgacagaagtgtcacgggagtgttacctgctataaagaaagcctaagaattattacctttattagaccagtgacactgagctttagccatacatttctaacttctgtccctctacagagacaattttcttttcttaaataaactgtcatgctagtgttaatatattgttggctctctcatgctctgagaatactgctgatataaaacatgtatatgttagattggtaatagtatctttagtgtagctgactagaacaaatgtgtttccctcatggctgtgctaatgtgataaaggaaaattggctgttcatcagcttttggctgggtaaagacagtagagatggaaccacattcttttttatgcattaataccactgagaacttttcactagttatatttcatgtgcctgcatgttgtgcaaagatgttgtaaaacatgagataatgctacaaataacaaagtagaaaagcctgtatcttttataatgataacagtcaaacaccaaatgacagtaacaggctgtaaaaaatgggatgcaaaaaaaatgcagccctactacccaacaaagcggaatatatccaggcccttgaggacttggtatatgatttgaggtatattaaagctttgttttaaaattaaatcaaatgcaacactagatcaatggatttaagaaagaacatagtttaaatgaaagtagggtggttagaatggagaaaagccattgtgggtaacttcttgaaataatccgtattaccaagtaattattgtagtaacttcctgttttttttgttttgttgtgttttgcttgtttttttggggggggacattgaaaaagatttttaaggcaatagtacacatgattttaagatgtttgagaataaatgtttatcttcattaattattgcaagtctttttaacataaaagcattaaaagtataaccagtttcaggctcacagcaaaactgagtggaaatttcagagatctcccaaacatgctgtacccccatgtacccacagcctccccctctattaaagccctgcaccagagtggtatatttgttacaattgccggacctacactgatacatcattaccactcaaagtccatagcagaatagcatgttgaatgttttgctatcattttaattaaaatgttaacatccaacctttcctttgcatgaccttaaatctcactctttcctcccctctctcaacccctcccctttccagagccttttatttgccatttcagctccttcactaattagagtaccaattattcctttttcatttaagctaaaagcacttgaacaaaaagactatttgcagagatgaagttgatgtccaaacagctgattagtttatttagaagtgtatgcaattaaaaattttgtgcaggtatctatgggtgttttccataaaagtttgatagcattggctattctgggctccagtcgcataaacaaaaatcccatagctttttaatcatgtaatccaagagttatcaagctacaacctgtgggtcaaattggctggccacctgtttttataaataaagttttatttggacacagccatgcccatttgtttatatattgtctgtggatgcttttgcattacagcattagagttgggcagttgtgacagtaaccatttggcccataaaaccaaaccatttgacttgcagagaaaaaaacattctctagctatttacagaaaaaaaaaattgctaatccctaatatgtgcagttattaggctacttgcttgattgattagtctagaatatgattggcaactttttgttaccctacattggaaaagtatatctgaaaatcaccaaccggataccaatacccaagacagtaaattcaagaaatatttgatcctagtaacttgaattatatccacatgcaattctttgttgttatatctggttttaattatttctttcccttgtactcattttgctctatttccaaatatagccataacaaatttaatttgtatttaaagaagtaacatatcctcaaaaaccctgtaaaacatggcaaccagagctgttacatgtatgggacaaactattatgtatacctgtgaacaccctgggagatatcatcacagcacaaaatgacactatataggtttatatctagataaacacatggagatatcactgagctattaaaataatgttttcagtcttcccagctgaacaaagtaaagaagaaagaaagttacttaataaaaactgctgaaatgtgtttaatataaaataaaagtttatgcacttaaactaataatggtggtaatttcttacaggtgcatcagacaaaaatcagcttctttatcaatggcgtggagaaggatcatacacctttcaatgcaagaactctaagtggttcaattacagattttgcatctggtactgtgcaaataggacagagtttaaatggtaagtttctgacttcagaatgttatttatttcatccaattacattgttcttaaaaatgcatcaaacaaataatattttaaaatatctacgtgtattcatcttctagggctactgaacaaattaccaccaactggatggcagattaatgaaagtaaaatttattttttcacagttttggaagctggaagtcagaaattaagggttcagtggtgttggttccttctggaggctctgagggcaaatctattccatgtctctcttcgtggtagctactggcaatccttagtgttcctttacttgctgcttcctaactgcaatcttgcctcagtcttcatgtggccttctcctctgaatcttctcccctttacctctgttataaggacacttgtcattggatttagggcccactcacagtcaggaggatctcaccctgagttccttaacttaattatacttgcaaagaccctttttccaaattaaagtcatagttacaggttccagatggataatagatcttttgggatctactatataacttactacatttgggaagctttcaaatataaacttctttattctgatcagtttttaagtaatttcaatgtgtaataaactatatttcctttctgtctcttttctgaggggtttgcattttcatgtagagaattgttaaagtagaactacgaagtattagatggaacctgagaaatagtattgacatgtaattaactggactgatgtttacatttactacattaaaaatgggccatatagtttaagaagatatcatatactatatattgaataaaaccagaagttgaaataagaaattatcttgaaatatctagtacagtggtctttaaaatgcctgcatattaaaataaaaatagtattttatattattatataatatatgctcattataaaaaaatctaaacaatatggaactctgtgaaatagaaagtattttccatatttctatcttcagagatagatataatttaacttttttatactcctacagatttttagtacatttttagctagagatatagttataaatacatttttccaaaaataaaattacaatacatatgcttcctctgagccttctaaaaataaatacttctccttcaaatgttataaacaacgtttcatgtcaatgtatcttctcatttagatatatgttctcatttaaaatggctgtattctatgcaattgtatagttgcaatccatgagatttcttaagctcctataatgaacatttaggtttttttaatgtttcagtgcaattagcagttattttatggaaaatattatatatatatccacatatatttatatatctgtgtctatatctacatttccatttatatatatcaaccatcaatctatcaatcatatacatagatgtatacatacgtacatatgtatttgagcagttgcctgattgcacagttccttaatatcctatttggtgccaacctgcgtgaattcatatcccatttcctcacttactagctatatggcctggcaagatattttaatatctctaaagtgtagtcaccccaactttaaaatgatgatgatgatgatcataatattgatttcccatagggccaatgtaaggatcaaatgaagcaatgtcatgtaaaacattactgtgtttcaagcacctggcatgtattagatattcaatatttatttgttaaatgaatgaatggatgaagtgctaagcacaatgcctgtatataaactatattttctctttcttgggcatggggctggattttaatgtacagcattgttaaagtaggactgtacagtattagatgaaaactgagaaataatattaacatataattaactggactatgtggtttatattttcgcacactaaaaattggccatgtagtttaagaagataacatatatgctatatattgaaaaaaattactaaactatatcagtaaataataataatattattattttattattatttttttttgacagggagtttcgctcttgtcgcccaggctggagtgcagtggtgcaatctcggctctctgcaacctctgtctcctgggttcaagtgattctcctgcctcagcctcctgagtagctgggattacagatgtgcaccaccacgcctaacttttgtatttttagtagagatggggtttcaccatgttggccaggctggtctcgaactcctggcctcaggtgatccacccaccttggcctctcaaagtgctgggattacaggcgtgagccaccgcaccctgccgtaaataatactattattaatgttattataattatttccaaaaaataaattcatagaagttgaatggctgggttgaagtatatggtcattttatattttaatacatattacagagattgctctaatgcataacaatgggctacctccagaaaggttgtgaaaatttataacctcattaaaatatatagccaagtacttgtttccttaaacactaactatccttacaaattatccacttttttttcacccttgacattcctctaagtgaaaaatattgttgaatgctgactcagaattatttggccattaatgagtttgagtagctttttacgtatgtcttgatcatttgcatttcatttatgaattccttattcatacaatgtgtccatatttatactctataattccttatttatttataaaaactcatttatgttaagaatattatgttgtataagttttcttcagttttttgatggcttatgaactttgtggtctagatattttaaagtaatcctttaatatttaagcaaaataaaacatgtatgcaagatagtgcataaatataaaaggtatagcttgatgagtttttaatatttatatacacctgtgtaactctcatttaaaaaaagtcgtagaatatttccagaatctcagagtcccctaatgaacatccactgtaaagataaaaacagaatagcatcaatgtagccctctataaccatagattaatgttgcctgttctcaaactatcatacaaataaaatcatgaagtaggtactcttttgtgttctttttgcttagcactatgccaatgagatttttccatagtgtatgcagttatatctttagctttagcaaataattctgtaaagttttccaaagtgggtgtcccaacaagcaacatttgaggatttcagttgttccacatccttatcaactgttagttttgccagatgttatcattctttgccattcttgtagccatgtagtgcatttcctgatcattagtgatactgagatcttttcatgtgcttatttgccaaatgaatatgcttttttgggaagccttttgccaagttttaattggacagtttgtatttttcttaataatttataggaggtcttccatattttgaatatgagttctttgacaaatacatgatagcaaatatggtcttctgggctaaggcttacagtcacattctcttgatggtatttgtcgataagcagatcttcttaattttaatgagtctaatttagtcattgttttatacttaatactttttgtgttctgtttagactatttttgcaaaccctgatatcacgaagatatcctcctacagtttattcaggaagctttattattttacttttcaaattttggtctatgttctatctggaatagattttttgaggttatataaggtaggggtcaaaatttttgtcccacctgaatgtgtaattaacctagaaaaccttgcctcttgaaacaaatcaatgtttctaccattctgcagtggtaacgttgtcgtgaatcaggtctctgtatatgtgaagatgggtttctttctgaactttctattctgccccagtgatctgtctgtctgtctatacttgggccaaaatatttagttttaattactgtaacttcatacatgtcttcatatctagtagttctccaactttttttcttttaagattgccttggctattatatatgaattttagaaacagtttttcaattttcataaaaaattctgttgagatttaaattactcatttgtatttaggagaatgggcatctgaacaatatcaagtatccagcccataaatgtaatatattccttgatttctcccagcaatgtttttagttgtctgtatagaggtctcactcctatttgttagacttgttcaaacatattcattggttttccttcttaatagactatttttttagagcaattttagagtcacagaaaaattgagtggaaagtatagagagttccagtatactctctgctcctacacacgcacagccttccccattgtcaatatccctcaccagagcggtatatggtatatttgttacaattgatgaacctacattgacacatcattatcacccacagtccatagtttacattaaagttcactcttggtgttgtacaacgacaagtatccactactccagtatcctacagagtagcttcactccctaaaaatcttctatgttcctcatattcatccttatctctatcctaacccctagcaatcactgatcttttcactgtctctgtattttcaccttttctagaatatcatatagttgggataaaaaaatcatgtatcctcagattggcttgtttcactgagtaatatgcatgtaagatttctccatgtctttcatggcttggtggttcatatcttcttagtactaaataatattccatggttagatatagcatagttgatttattcattcacctactgaaggacatcttggttgcttccaagttttggcaattatgagtaaagttgctataaacatcagtgtgtaggtttttgtgtgaacataagttttcaacttataaataccaaagagcgcaattactggatcgtatggtaagatatgtttagttttgtaagaaactgtaaaattgtcttccaaaatgactatatcgttttacattcctatcagcaatgaaagagagtccctgttgccccacatcctcaccagcatttggtattgtcagtgttctggctttttggcctgttggttttcatgcaattatacttagtattgtttttgaacttcatttgctaattttgttactattgcattaaaatctaatcagtttttatatttacctatgtttagtgaccttgccaaactcattattatgataggtacacaatcctatcatttgcacatatcaggaactcaactctttttgaatgtttgtaataaatgtatataatggacatgccataaatatctcctgtagatatttttgtctgatgcacttattaattctgaaataatataaaatgttattttgtttttctgtatgacctgagttattagaccaatgtctagttttaaaaaagaaggtatatatttttgatattcaaaacactgtggttaaattgccaagctctggtttaaatataacccaggtgtgcttctttgatcaaaatattaactctctttaagtctggtttctaatctattaaatggtggtttaatatataattcataggaatcttataagaattatgtgagatgatgtatgtttagaatataagttgcttgttgtatagtaaatgtgcattaagtggtaactatttttaaactctttgaacatcaattttcttattgtgaaacaataagatagggataacactatatttccatatgattgttgtaccaatcaaaagagaaaatatgaagaccgtattactttagtttgtgtatgctcttagatcaagctaaactcatgtgaagaagcaatattttaaggaacttatatatttaggaacttggtttgagtaattagtataatgcataatcttataaaatactctgcgtgaagaatttttaaataacacattaaatcttgtgagccttatttcaatatttaatccccattagtacttctaaaagtgttttattgcaccaaatgttgctcaaagtatttgatagcgccataaattagtcccctatgcactgcagggttaaaatggcttgcttctattctacttcagtatactaaatgttggattaatgcttcaaaagaacagtgtgaactgaagatgatatttttaaactgtgtagaaataaatttcactcctgattagaaaacatgtaacaggaaaccggtttatttcaaatattatttagttttcattacaactttctcctttatgttcttgacatctgagagctacagaaggaaaaggatattttaaataatttttatctttattctatcaatttatatgtacagtcgtacctactgtatcttttctctaattagagatggcgtatagactggctcattacttctgcctaatgagccaggctccatgccacctctctaatcagaaaagagataggtacagaatgttcctatggacttattataaatcattttctttctcttacttgctcctttttttaatcaaaaaattaagtcactgtcctccatacttttgtccatatccaagatggtttctttcaaaagaggtaattgtgcaagcgattactgagctgaattaaaggtgctctcatgcagtgccaggccggctgtctctgctttggaacagacactgcctcaaacacaagcacatcaaatgaaggcctatagcagatcaagatggatcttttctgtctttctctgattaggtttgacttggttctctgtttctgcacccagaaagtaacaaccttccatatgagtgttggctactacagagctttttctttgagtcttatctctagcataactctctagaaaaatgtgttgccagtgacactttctgttactgcaggacttgtctttgctttccctggaaaagtaatcaatggaccaaatgcatgctttttactgaaccctcatttatccttattaatggtataatctgatttgatcaggctgaattttatgtatacaaatagaaacaccttagaccatctatatcaaccaaagtgtgatggctcctttttagaacattttcttttagttgtagatttattttagtgcttccaattgggtatataacctggagcacttgtgttagcagatatgtagttatgaggagtcagcaatgtcatcgtggtaataaaccatactagctctccaaattttggatttaaaattacagaactacatgaatcaaaacttttcccagttatttctgaacttgtttatcaacagagttctagttgccgattaaaggtgagaatttctacattatacattcaaatgtgcatagcactttcttaagaagatcattggtcattaaggaatcaataaatatttgttgagtgtctgttaaagtgaatatgcagggaagaaaaggatcatcgtctaaagctaactcctacttgccttcctttctgtgttttcaacgttgtgtgtcttagcccatatgcttgtacttgattctaaagttggaatgctacttctaatttctaccagtttcccatgggttcacatttctaacctctgctagatacacaaactccattttagttcagctgaaatcatgctaatttttttcagagagaattatttttgggaattagatttaaaaaaagcttagaaagtattgaaattgactaagagattggaatggaagaagagtataggaatatagtatatagataggagtttacttagtttcagaacattgcagacaaggtatctagcaatattatcagacaagttatgttgtatatttaaaatgatgttaatgtagctctctcaaccatactaagtaaaaactgctgattaattaaaatttgaatgcaaaatatgcaatcataaggtagtagaggaaaatgaaggcaagtgtttctataattctagcatattaaggacctttattagcacgataccatgtccagaaacactaaaggaaaatattgaaacatctgactattaaactgggaatttaaaattcaaacaacgattatcattttgtacttgatagtttggcaaggactagaaaagcgattataccggtgttggaaatagtttggggtaacctggcaaactatcaaaagtaaaaatgcgaaaactacttaatccaagatttctacttccaggacactatctcgagaatataattagacaaagacttaaatacatactcaaaatgttcattgtagaatgatttaaagtaacaaataactggaatcagttaaaaacttcaaaaaggaattgatttaataaattataattcatgcctactgtggaatagtatacaccatcaagaggaatgaaatatgtctctttctatgtacatggcaatgggttcatgatgtgttattacatgaaacaaacaagattgtatagtacaaaattctataaatttaatgtatatgttataaacatacatatacatattaaagttctggaaggaaatatgccaaaatgttcttcagaatgttagtaatgttaatctctatgagtgggattgcaaataattgctttttaaatttctttttgtgcaatttttttcagtaaactataattttataataagaattaaaaatattttccaattttggacaaaataataaatggaagcattttcagaatagatttattctatgaatgtaacaagttcagccagagacacctaatttgtatagtacagagggtggtcttgaaaatgttagtcatttaaattctgtacttgtcacatggattcaggaaacacaagcgttcattggacatttaactcattgtacatacaattattattactataataatttgtgcctgagaagcaaagcatgagatttagaatcagacagatttgggtttgaatgctagttctgcttcttaacagccaagtgactttggcaaagaatataacttctcaatccaatttcctaatatgttttctcatttataaaatgtgttttatacacatacttttcagggtgatcagagagcttataaataacacatgtttgattcatgttaggtattcaataaaatttcgctatcataaatattattgttaatttagttattaagtttattgactgtgatacttaaaattttaacataatggccatgaccatatttaattttttttggctgaaaatcaaaatttacttagggtgagggagaaaaaaagtccagtttagattcattatgtagcagatattttaaaattctgtgttttgtctatgtaaaccccacaaaataatttctctctctttttaaagatctgtcctttctagtgttcttcaatgtttcctgttcatcctcacttccacctgatgctatttcttcttaatccgaagaacctcccttttcattgcttgtagctcagcctgctgaagcaaattctctcagcttgtgtaaaaatgtctttacttttgcaggatattttcatttgatatagaattctacattgattactgttacttcttttagaactttaaagatgttgtttccttgtcttcttgccttcattgtttctggtgagatatcagccactatttatataaatgttttcttgtatactatatgtttctttccttctttctttctttctttctttctttctttctttctttctttctttctttctttctttctttctttctttttgaagcagagtctttcactctgtcaacccaggctggagtgcagtggtgcgatcttggctcactgcaacatctgcctcctgggttcaagtaattctcatgcctcagcctcccgagtagctgagattacaggtgtatgccaccatgccaatttttgtattttcagtagagaccgtgtttcaccatgttggccaggctggtctcgaactcctgacctcagatgatccaccctcctcagcctcccaaagtgctgggattacaagtgtgagccaccatgcctggcctatatattgttttccacttgatgctgttaagattttatttttatctttcatgttatcagtttatgatatgcctaggaatgattttcattatatttgtcctgcttgaggtttgcttaaattcttggatatgtacgttggtgttttcattacatttggaagttctgatagttgtatcttcaaacttttctttctttttttcctttttttgcttccttttctttcttctgtaataagactctagttagattgatgttagagcactagatattgtcccatagatattgggtacagttttgtttgttcctttgttttcattttccccactcttttttgtgtttcagtttggatactttctatttgacttgtctttatttcactggtcaatttctcttttgtgtctaggctgctgctaagcccatctagcaaactgttgatttctaaattatacttttcatttcaagtattttcatttggccgttttgtagacttcatctattggctcaaattcacccatctatttgcatgtattattcactatcacccctagatcttttagcatttatattataggtattttcaaatccctatttgataattccaacatctgggccatgtctgcatctccttctattgactctttcctctctttacaaagggccacattgtgttgatttctcatgtgtcttaaatatttttattgtatgataaacactttgcgtaaaagaatgaaagaggtggaagtaaatcatattttttggcgtttttccctttacaaagaagagcactgctggttctatgagaccttttgaatgggggtgggcagtaggaaagaaaaaataccaaactgacttgaagttgatctgtacgtgggctttactacagttttaatattatttagctcactactggtttcagatatctgtggatagaattgaaaatagttagacacatgtctggtggggcctccttagaattctaatatgtcattctggcctctgtatggctgcttctttcttactccttctatgcctgaatcctctatttcttacctctgagctaagtatgggagtagccctgggtctcgtccaatgagttacatgtccagtaaatgtttgtgtttcctacaaaaggcttattactttctagaatttaattcatttagttttttctgtgcgctctacattttgattggttaaaaaataatgactttagggcttatctggcttgttttggttgttagattgacagcaaagtgatggtcccttacaactttttacatttaaagcagatgttgaactattataacaacatctaatttatacccctttttttctttggcacaactctgtctatacttaactctccaaccctctagattgtttcagctatggctggtcactgactctgaacaaaaaaggtgcatattacttggccccaaagattattttggtagaattcaggcatcgacgttttaattacctcctctaatttttcatggggattttcagcttttgtgggccctaatttatccctgactcttaacttttatatctgtttctttggtttgcctgaaatctgtttactgctaatatttaaaactgaaacatgtttttttataaatctagccattggatcttgtttcactaatgatcatgtggcatcgtttaatctcggtgcccccagcggctctgtttgttcagtttgtatagcacatgcatctcttgtgtttctttttctgtcagatacataatcatattgattagtgtataccccttataccctgagtccaaaaattcctcatccctcccgggatcttcaaatgatttaacgactttccactatctctcactttttgatgtggtctgttccctccttactcaacttaagtttcatggccagttattataaccacttcttttcatggaactggacttccctgccgttttttcttcacttctactatgatcttggcactaccacagcataggttaaatatacccaaagaggacgactcttcccaccttaaactcatgaccatgaacttcctatgtttcctgatgctgccctgtgatcattccatatttccctcattcattcactttcctgtcttatgccaactatttatacattttcctttctcattatcctgatcctcagtgattatattacctccaactttaccataaaaattaacaaaaagaataaaagagcttctatagatttccactgctatatttatccaccactggcataccacctattaatagatctgaccaagaatatcttgcctcatttttccccaatttactgctgtattgtaaaattttcttgtattaatggaacattttcaagggaataaaggcatgttgttatttttccatgaaaaattattcttgaccctcccccatttcttctactagccattgtcttatttatttgctctccttttagcaaaacttcaccaaagtatattcaaccataggagcctttaattcctcttttcaaattccaccatctacagtcagactttagctcaccactgcacttaagctacacttgtcaaatctctactcaccttcacattataaatctaatagttaatttcaagtctttatctttttgacctattaacatcatttaatggagttgatcgctccttcctccttggtatacgttcttcacttggcatctaacactccatcatctctctgagtttctagttgctgcgtctcagtttgatttactggttcctcttcatctacttgacctcttagtattggtaccccaagccttaagacttagctctgctcccgtgtctacagacactcactcccttaaagatcacctccagtcttatagctttaaatgtcatctaagtgacttgacctccaaatataaatctccccaccccagcctctttcctgaactccagacgactctgttacatgtatcaaactacccaaagtctccatttgaatgtttaatttacatttcaaaattaaacttactttttttcaaaatggaactggttttcttaagctctctcactttgatccatatactacttcttccatggtcttcctcatcacaagtgaaggcaatttcatttttccactaagacagagaaaaagatttggagtcatccttgtcaattctctttatctcatgttcaacatttttttttttgttttgcaaaatcttgttggtgttagaatcaaaatatatccagattttgaatccttcttagcacttccactagaatcatcccagtccaattcatggttgctgctttgccgggattactgcattgtcttttaactacttccaggcactccgctttattctcaacacagcagccataattgttctgttaaatatcagtcaagcatattacttctctgctcaaaatgctctattgtttctccattttaccagagtgaaaaccaccattcttactataacctacaagacctaactgagctaacagcagttacttctctggctttatttcttacatttgtttattttgttctccttgttttacacaaattggcctctttgccgatttttgactatgggaggtgcacttctgccttgataccattcgctgttctttcaacctggaacttttcacctcctgatatccatcaggctgactcccttacctgattaggtctgctcaataccagtttcttaaatacatctttcttatcaccccgtttacatctgcaaacaccacctccccactttgggtctcattatgttgctctattcttttccatagcacttagcatctttaatgtattatagaattgacttatttttgttgaatatatctgtttttccctctataatataaaagagaaagcaagattttttttatttgcattactcactgatataccccaggatccagaagattgcctatcacatggtagctactcaatacatattttccaagtaaatgaatcgatgggcagcttccatgcagcattaagcctgtgggtgtgtggaatgcaagaattgaagcttgggagcctctgcctagatttcagaggatgtacagaaaagcctgggtgtccaggcagtggcctgctgcaggggcataaccctcatggccctagaacctctattagggcagcgaaaaggggaaatgtggtgttgcagtctccactgagtcccctctaggacattgccttgtggaactgtgagaagagggccaccatactccagaacccagaatggtagccactggcagctttcaccctcagcaaggaaaaactgcaggcactcagtgccagcatatgagagcagccactggagctaagccctgcaaagtcagaggggtagagcttcccaaggccttgggagctcactcctcccaccaatgtgccctggatatgagacgtggagtcaaaggagattattttggagcactaaaatttgatgactgcccttttgggtttcagacttgcatgggggctgtagcctcttttgtttggctgatttatcccgtttggaatggaaatatttactcaatgcttgtatctgaattatactttggaggtaaataactgggttttgattttacaggctcataggtagaagggaattgccttgtctcagatgagactttggactttggagttaatgctggaatgagttaagactttgggagactgttgggaagggataattgtattttgcaacatgaaaatgacatgaaatttgggaggggccagaggcagaatgacatggtttggatctgtgtccccatgcatgttcagttgtaatccccagggtggaggtgatacctggtgggagatgattggattctggaggtggatttttcatgaatgatttattgtgatagtgaatgagttatcacaagatctggttattttaaagtgtgtggcacctcctcccactttgctcctgctttccacatgtgatgtacctgcttctccttcaccttctgccattattgtgggcttcctgaggcctctccagaagccaaacagatattagcactatccttcctgtaaagcatgcagaactatgagtcaactaaccctcttttctttctaaattacccagcctcaggtatttctttatagcaaagcaagaatagactaatacattatcctttgttactgatgtctaaaaatcttttttaaaaaaattaaaagcaagtatattaagacagtaaaggaataaaaaatggctactccataggcagagcagccccaaggactgctggttgcccatttttatggttttttcttgattatatgctgaataaggggtgggttgtttgttagttttccctgaaaggggtgggcaattcccagaattgaggatccctccctgttttaggccatatacggtaacttcctgatgttgacatggcatttgtaaactgtcatggtactgatgggagagtatcagtgaggacaaccagaggtcactcttattgccgtattggttttcgtgggttttagctggcttctttactgcaatctgttttatcagcaaggtctttatgacctgtgtcttgagccaacctcctatctcatcctgtgacttaggatgacttaccctcttgagaatgcagcccagtaggcctcagccttattttacggagcccctattcaagatggagttgctctggttcaaaagcccctgacaattaccccctcctttttaaaagaaagctcttaatcttaagagttgtagagggatgaagatccatcttctctaacttcttcaagctgaataggggtgatgatattcctgcctaacaattagggtctcttgtctttgggatagagaggaactcaatcagaaaatgctggtatgtcaaggtccattcagaatacttgagttctgacaaaagttgatacctggaagattaataagtatttaatttaagaaaacattcggtaagcttatcctacacaaagagtataacagcaatacattccgcagcagtaaagcaaaataaataaaattatcacaactaaactaaattagaagactttccatgaactgggcaattgttagaaccaagctaatatgtggttgctagtaaatcccagtatgtgcccagaattagaatattgatccagattttgacattgcccattcattttggttttttttgaatagtagtcagagatcacttggtggtacacagaaataagcagagtctgtctaaattacagaaaaaaaaccttaaacacaactaatgagactagaatctaataacaggtgtaccatagtttttgaagcaattctttttcttttcagtctctcatttttactaaagacaaattataatagaatcgatttgtgcgcaaaaatgagctttagtcttatacttggcctgattacttgtataaaatgctaaaaaataactatttttcacataggattttaaaattggctttgatggaactttgttccataaaaaggaatctcagataagacctttttaaagctgagcccagccctgggtttgtacaatcaaatacctatgagttgggttaattcctttactcttgaggtcctaagatatcttcgggcccctgagtctatcagaaagtgacattctttacttatcacaggtcaggaaccctgtacagggcatgtgtaaacaaagaatgtgaccagttttcccaaggggtttttattggctttataagtcaagattgattccttaaaggaaagcacaccattccagtgaaagtcttggtaaaataacaaatttttccaattgtgtcctgttacaaaataaaacagatgcttattgcacttatgcaaatatctattgtcataagttaagaatactcacaaatagtttctaaattctgaagaaattaggtagaatcaaatatgccccaaattttgtttacaggagtaaaatttactcaattgttaaaaagctgtaaatagcttaaaagaaaagttgccttggctctgatagcaaaacaaaggatcagcaacattttaagcaaaaagttttaaaagattacttcagctatctattattcagcccatgcagttaactcttgttcagcttgatattcatgaacatttcagctctccatcagtactgaaagttttatcctctcttctaatgtcacaatcttcaaagttattagaaacgtgcattcaagagcacctgtcaaaatcctatagctgactctaaacttactttttaaagaggattaaaacaggtcaacaattttctatggatgacaaaaagttttagaacgacatatattaaagccacaattgataaagaaattttggttagttctgtgacatacaatgattttactgacaattataactattactgataatgtacactaagtcatatcagaattacaggactttcccataattttggaacacaaaccaataacatatttttacaaatacagtccaaagaaagcaaagaccatttcatatttttctatgcttcctgtatgatatttataccaaataacctgaatatgccattttggactttaggccacctaatagctaagagattaattaggtcagaagaagacatactttgtaattttattttggaaagcttgtcaaatattaaaggtttaaaacactggatatcacaaaatataattccaggtcatcataagtcattcattaggccaaaataataactcaaaaatatttaaaggggaaaaacctttactcattaatagagggaagacttagatctccaaaccatctgtctcttttctttcctttcctatataaaatttcttttttagaaacaacctctttgcatagttgggaatatggctaattccacatgtccccaggccttatctagaatctaaagtctccaaagtaggtaaattgaacaattttcaaaagtcaaagaagcagtttctgaccttaaagcatttagtaaacttaatatgtgacctgcctaatttagaccaaatgtctttattttatcaataatttttaaagctgtttttatttcccaaacattcctaaagtcacatgaactaaaagtgattacactttttacttttctgacaaaatatttgatttagacacttattatttttaaaccgattaatcaaagctcttttatatcacatatgcagcacatataaatacacagacagaaaaagatccagtaagatttttcatttttcggtttcttaactggattactggcttcagggtggagccttagaggaacagagccaagaatgcgtgaaatttctaaagcctaataagcaggcacagctggaaggcaaactagatcttcaggaattaagggttccattttaatagcagattctggatcccaaaaagagggaattagcccatctcccatgggagtcttacctctcagtggggagtgggggcatttccataacttctaagtgaccaagagcatgcttctctgatccaaatgtgcaaagagccaagtattccataactgccattagccattctcaaaagtgtatttcctacctagttattgcataccaaagctctttcctaatgtaaagtgatttctgatacccccaaaagtaaaaaacatcagataacgcaatgcgaaacacaagacagccttagattttgagagggatctatccatttccaattcctgggatttcatgaggaaaacagatgttttttctcaaaatggggtctgtggtgctcctttttttcccaaggagtcccaggctgttagaacttaaatatctgcttttaattaagctgacttttaatggtactgctgtttttaaaaagtcctcttaaatttcttattacctgactttagccaggcgaaactgtcaataattctggcttttgaactttatcaaaggtaacctcccaggtgttcagagaaaggaaaattcaagacagaccattgaggggaagagaatcaacaaatgttcatgcgcatatcaaaccagaaaggactcattccctaagctgggaattgaaccctgaacctgggtcaccattgtgaaaagaaagcctcagctactgagctactcactgggcagtttccattgctcttcccagaaggagtctagagcagcagattttgagcttgcaaaggttttaaatgctcaagataattttgtagagctaactatgacatgaacccccaaattcctgttttctggatggtagagacctagagaaagtaccgccatgtggtcacaaggtcaagctcccaaggacataactagccagtttgctgggccgtcttgaacagtaggcttatggggtcctaagcttgtgttctatcctaaggtacccctctttctaacagaaatatacaggaagacaaattcacagtgcaaagtacaacagattcactgtagcttaaaactagcctcacaaatcctttttcacattaatcagaactttacagaggagataaacagtgatttttaccattctttgaactagtttgcacagagagaaagagagaggacagaagtctcactggtaagaaattcttacccttttgctggcatgccaggcttctgggttccctttccctgagcagtcctagtgacccagcttgacgcatcatagccctgggggccaagctgcaacacaaaggaaaattgtctttttttctgtcctggccagagcaaaatatgtgtgacatagacattagccactctgctcagcatccaatatcaaactaacaaggctcaaatttgcccctggttggaccctgtcatcattaatccaacctctgaccagaagtttcaacatgtggtctctgggcaagatggtcaccctgagtaagagaaaaggtaagaaagggaaaggagagaaagaaagaaaagcattggctgcatacagcagggtggggaaggcaaaataatcaaggataccagagaaagaccctcccattgcgcaaaagttcaggctgccgcttgaagggatctgtcatgaagggatcttttccagtagtcccattagctctcaaacatcccccttttgggaggaaaaagctccccaagtcccacattcacatgcatgcctaattatgtcacccacagccatcagcaaagagggcaaggcagattaacccaacgagaatagcagttaatatctcgtattgccaaacccattattagctgagagggactttactgagaggggcctgaaaccccctaaatcttaggaaggactctaaccttcttaagttgggccttgaatccatgttctgtcaagtgtccttgtcttttattaagaggggcctttaaccacctctgtcttaagagagactctaacgcccctaaattaggcctctaacccatttccatcctttacccaagcaaatgtaccccacttacccagagtcagccaataagtgctgaagtctatttcctttgggtcaggggagtctcctccgtgttgtcccttccatggttcaccagaaagatgttaccagaaagaggtccagatccagaccccaagagatacattaaaacaaagcaagttttccttttgaacttgtcaaaaattccatcttgtaaaggatattaaatgttgctttaagctgaaccttgagcaaattaggtggtttgtgtgaccatacatgtatgtggtggcttcttgtttgcaacttcaaggaacaagtattaatagttcagtgtatgatgttgatttgagttgagcatttgcagtttggataatcttaaattttgacagacactagctgtggagactctttctgttactaaatccttttgttttgaagctattgccattcgtctttctcttgtcctttatattttttgtctgtttctttaagcttttattggaaatgtgcataagtaaagaattacttgtgttacttgccaagcaatgcacatttcatagttttaaatctgtaatcagcaataaaaatcctaaaatatgtatctaagaacatcttaaaaaattctttctcactcaagaaagaattcaaggtgagtccatagagtaaagtgaaaccaagtttattaagaaagtaaaggaataaagaatggctactccgtgtagagcagcacccccaatgtctaaaaatcttaacaatgataataaaagcagaaaacatatggtaattttttggcataaaacccttactgcagtgagcattaaaaacaaataaactgctttggttcttcattctagagacatcatatttaaaaacttagatttcattatttgattttcattttgttacaaaataaaatattcttagtgtcacactaaacagagatcagataattaacctgaccccatgatgcataattttaattttaatttcaatttgagttcttaatagaaataatgaaaggctgttatcatattttggttgaatggacacagatctatttttttatggtaccacattgagaatttgtttttttacatatataaatctattaatggtattgtcaaaatactgtcttttttttttttttttaagatgtagtattgctttgtcgcccaggctggagtgcagtggcatgatcgtatcctagtgcagtctcaagtaatcctcctgtcatagcctactgcatagctgggagtacaggtgcacaccaccatgcctggctaatttttttttttttttttttgtagagatggttcttactatgttgtccagtccagtttgaagcaatcctcctacctcagccacccaaagcataggcatgaaccatcaagcccagctagtcttttaagctttgttgttttgaaaataatgaggattattactttgatatcatattagaattttttctaaaaatttaacaagaaattatctttagttctgtataatctgtgggcagctatatctatttataagcatctatgccaattattactttacttctagttgtaatttaaatttgttttagttttcaaggacacagctagtcttaataacttgatttgtttttatttccatttattgagtttagcatttataataacttaaaaaaaattttatttcactttaagttctgggatacttgtgcataacgtgaaagtttgttacataggtatatgcgtgccatggtgatttgctgcacctatcaacctgtcatctaggttttaagccccacatgccttaactgtttgtcctgatgctctctctcccctccccacacctgaaaggccctggtgtgtattgttcccctcccttcgtccatgtgttctcattgttcagctcccatttatgagtgagaacatgtggtgtttggttttctgtttctgtgttagtttgctaaggatgatggcttccagcttcatcagagtttctgcaaaagacatgatcttattcctttttatggctgcatagttttccttggtgtatatataccacattctctttatccagtctatcattgatgagaatttgggttggttccatgtctttgctattgtaaatagtgctgcagtaaacatatgtgtgcatgtgtctttctagtagaataatttatattcctttgggtatatgcccattaatgggattgctgggtcaaatagtatttctggttctgggtctttggggaatcaccacactgttttccataatggttcaactaatttacattcccaccaacagtgtaaaagtgttcctgtttctccacagtctcactagcgtgttgtttcttgactttttaataattgccactctgactgaaatgagatagtatctcatggttttgatttgcatttctctaatgatcagtgatgttaagctttttaaaaatgtttgttgactgcattaatgtcttcttttgagaagtgtctgttcatatcctttgcccactttttgatggggttgttttcttcttgtacatttgtttaagttccttgcagattctggatattagacctttgtcaggtggatgggttgcgaaaattttctcccattctgtaggttgcctactcaccctgatgatagtttcttctgttgtacaaaagctctttagtttaattagatcccatttggcaatttttgcttttgttgcaattgcttttggcatttttgacatgaaatctttgcctatgcctatgtcctgaatggtatcgcctaggttttcttctagggttttaatgattttgggttttgcaattaagtctttaatccatcttgagtcaatttttgtgtaaggtgtaaggaaaggttccagtttcagtattctgcataaggctagccagttttcccagcaccatttataaaatagggaatcttttccccattgcttgtttttgtacagcttgtcaaagatcagatggttgtagaagtgtggtgttatttctgaggtctctgacctgttccattggtctatatgtctgttttggtaccagtaccatgctgttttggttactgtagacttgtagtatagtttgaagacaggtagcatgatgcctccagctacgttctttttgcttaggattgtcttggctatatggactctttgttatttccatatgaaatttaaattagttttttctaattctgtgaagaaagtcaatggtagtttgatgggaataggactgaatctataaattactttgcgtggtgtggccattttcatgttattgattcttcctatccatgacgatggaatgtttttccatttgtttatttcttctcttatttccttgagcagtggtttgtagttctccttgaggagctccttcacgtcccttgttagctgtattcctaggtattttactctctttgtagcaattgtgaatgggagttcattcatgatttggttctctgcttgtctatttttggtgtatagaaatgcttgtgatctttgcacattgattttgtatcctgagactttgctgaagtcgtttatcagcttaaggaattttggggctgaaacaatggcgttttctaaatatagaatcatgtcgcctgcaaacagagacaatttgacttcctctcttcctgtttgaataccctttatttctttctcttgcctgattgccctggccagaacttccaatactatcttgaataggaatgatgaaagaagggatccttgtcttgtgccagttttcaaagggaatgcttccagcttttgcccattcagtataatattggctgtgggtttgtcataaatagctcttattattttgagatatgttccatcaatacctagtttattgagagttttaacaagaaggggtgttgaattttattgaagcccttttctacatctatcgagatgatcacgtgattttgtcattggttctgtttatgtgatagattacgtttattgattgtgtatgttgaaccacccttgcatcccagggatgaagccagcttggtcgtggtggataaggatatgctgctggatttggtttgtcagtattttattgaggattttcgtattagtgttcatcagggatgttggcctgaagttttccttcttttttttttttttgtcatgtctctgccaggttttttgtatcaggatgatgctggcctcataaaatgagttagggaggaattcctcgttttcaattttttggaatagtttcaaaaggaatggtaccagctcctctttgtacctctggtagaattcagctgtgaatctgtctagtcctgtgctttttttggttggtaggctattaattactgcctcaatttcagaactcattattcgtctattcagggattcgacttttcctggtttagccttgggaaggtttatgtgtccaggaatttatccatttcttctagattttctagtttatttgtgtagaggtatctatactattctctgatggtagtttgtatttctgtggggtcagtggtgttatcccctttgtcattttttatgtgtctatttgattcttctctcttttcttctttattagtctagctagcagtctattttgtttgtttgtttgtttgttttcaaaaaaaacagctcctggattcattgattttttgaagggtttttcgtgtctctctctccttcagttctgctctgatcttagttgtttcttgtcttttcctagatttttttatttgtttgctcttgcttctctagttcttttaattgtgacactagagtgtcaattcgagatctttctagctttctgatatgggtatttagtgctataaatttccctcttaacactgccttagctgtgttccagagattctggtatgttgtttctttgctctcattagtttcaaagaacttcttgatgtctgctttaatttcattatttacccaggagtcgttcaggagtaggttgttcaatttccatgtagttgtgtggttttgagtgagttttttaatcttaactctaatttgattgcattgtggtctgagaaactgttataatttcagttcttttgcatttgctgaggagtgtttactaataactttttaaaatatcagtgatttttccaggtaatagacatttatggctttgaaatttcaaagtatgtttaaacaaaaaaattcatcaacaacctcctcccacattctgcatttacatttatcattatcatgtgtgttcttatacttttattattagattgaaaaatatacaattgccattcttatagattaaaaatggtcaaacattggctatttcaaatagttcaatatgtaagtatctcaaaataatataacacatgctgttatctttatgttgttagtatttatgtaagtgctcatatatatatatgcacatatataaaaatacagagtatatcttcaatttgcctttttcataaataatttttctgagaattacccattttgatattttgttcattcattttagtttctctattagtattccactttataaaaaaaagtatggattatgtatttgtttccatgtggagagttagcttttctctttatataatttatagaagattgcaattaatattttgtatgtctccttgtgtgcatttgtgagaatttgcacagaaaaagcacagtgaaaggtatcataggcttcttaagtattcttatcttccattttgatatatcgccaaactgttatctaaagtggttgaaccaatttgccttcctatggcaacaggtaaaatacccatttgcctgtgttatcaacatgttttgttttccaacatttttgccaaaatcatgagtataaaatactcccttattttcgttttaattttaatttctttagtaactattaaaatattgaaacatatggcatttgagttttcgcctctgtgaattgcttgttctggtatatctttcattaaattttccattgcatttccttgtcagtaaaagttacacttataatctgcattttacatgttttaattatattgattgtaaaaatatttccttcagtggtttgacttttaaaattttttgtatttttggtctgtcacacaagagttttaaattttaacattggcgaatatatcagttactttttatggttcagatagttttatatcttacttaagaaattctcttttatcatgatatatattgccttctattttttctgaaattaatttttgtataatgtgtgaggtagagatttaattttaacttatctttattggcacattcttgtcccactgatttttattgaacacacattatttcctcactgatttttaaagccacctctactgtatctcaagctccaatttgatggtagtgtgtttaacatcttgtttcagaggtcaatttgattaacttcttgccaaaagctatagcacttgattatcttttgatatcttgcagtggattccttcttaccagccttcttcagctattgttaggtcttactcctccaaatgaattttaggatcagtttatataaaaatgtttattgagattttttattggaattgaattaaatttatacaacagcttagggataatttatattgttatgctgatttttttcatccatgatcatagtatatcattctatttatttagatcttcttttatgtcttttagtaaatttctataaataaaatactcataacttataataaaagggataaatataaaatttattcctaggtatctcaaggttttggtgctattgtaaatagtatcttttattaaattgcattttatatttattgctgatataaagaaatattataaattgttatatatcattcttatttccaacaccattttggaacacattaattcgaatatttgactatagatttatttgaattgttgaggtagaaaaccatgtaatttgcaaataatatatttatgtcattctaattcttatggattttacttcttttctttgtctgattgtgaggtctagacattcctttaacaatcttggaaaaaaaagcagtgagagcaagcatcctcaacttgtcattgctttaatggaaatggctttacattttttcctttaaataagatgtttgccatatcacgttaaaaactttcccacctattcctaattgtttagggttttctacttgtatattatgtatttttcaagacatggcagatttaatttgttgagatataattttcatgcctatgctaccaagtgagattggtcctgtcgttttcctttctcttaatgtccttgagaacatgtttcagctctcccatttatgacctgttttaccttgggcaaatttcttaatatctatatgcttcagtttcctcatctttaaaattagcatcaaaagaatatctttccatagtgtttttatgaggattaaataaaataatatacataaagcacacagaacagggcctgctactcagtatgcaatagttattagctgtcattgtcatcattaatattaagatattttaaaacacttttcccctaaaatacttagagtactttgatgcatatcctaagatctgtctctggctgctatttctggacatttctttgttgtaatatttctggtagctcttacttgtgactgtgaattgtagacatttgatgcccacagactattcagctctttcaacttctaccttgttcctaaggaaatctgaatcaattcatcagggtctttcctaaagaaatttgtcgaagttatccaatccaatgccacgattatatttcttcttgtatgattgtgtttttgttgtttgtcaaagaaatttttgcccaagtcaaggtcacaaagaattttcctgtaattttttctagctatattatagttttaggttagttctattatccatattgagttaaacttttacataaggtgcatgatatgttttcaggtgctttaaaaaacataagatatccaatattccaggaccgttcttggaaagaagagtattctttttccatttaattttctttgccacttagttaaaatacagtggactgtgtatgattttattatcagcattttcattgctactgaaatgcagtaggtatgcaattgattttcatgtattgatattgcaacttgcaactttgctgaactcatttataattcctaatagattttagtagatttcttagagttttctatgtacaagagatagttttacttctactttttcaatatggaaagatttatttcttctgcttgcctatttgccctgtctggtaactacagaaaaatgttgactagaagtggcaaaagtggacattgttatcttgttcctgatcttagggaaaaagcattttttcaccactaaatatgatgttagctgttggtttttcacagataccctttattagatgaggaagttgtcttctttaatagttagttgctttttaaaaattttatcatgaagtgttaactttgactatgtagctattaagatgatcatgacgtttttgtcctttatttttccaagtttgtgtattacttgattacttttcgtacattgaaccagccttgcatccttgtgataattccacttgctcatgatgtatgatcctttttgttagtactgtatttggttcactagaattttgttgaagacttttgcatctgtattcataaggcatattggcctatagttttcttttgatgtctttgatgtttttggtattagggtaatactggtttcatagagtaatttggagagtgtttcttcctcttctattttttggaagggcttgtgaagtaatggtgctacttcttctttaaatgtttggtagaattcgccaatgaaagcatctggtcctaagcttttctttgtggaaatttttaaaaaattactaatttgatctcttttagtggtatagatctattcagattgctaatttcttcttaagtcagtttacatagtttgtgtgtttcttggaatttgtctattttatctaggttgtctaatttttggcatacagttgttcatagtatcccttatgatccttttttgtgactgcaaagtcagttgtaatttcccttttttaattcctgattttaatcattagagtcatctcttttcttggctagtctagttgaatgtttgtcaaatttgttaataatttctaacaatcaacttttgttgtttttcttgttgtttttctattctctattttatttgtctgctcaaatctttataatttcctttcttctgctagctttaggttgagtttgtttttctttttctagtttcttaaggtagaagattaggttattgatttaataaatttctctttaaatataagtgtttacagctctaaatatcactttaaacactacttaaatcccataaagtgtgatatgttgcatgttcacttccattaatctcaaaggatttttaaatctttttgtaatttcttctttgatcattagttattaggaatgggttaattttcacacatttgttaattttacaaatttgcttctgttattgatttctaattttttctattgtgatccaagaatatactttgcatgatctcagttattttaaatttatagagacttgttttatggcctaacatataatctatcctggagaatgtaccatatgcacttgagaagagtttgtattctgttgttgttgggtggagtgttctgttggtgtctattaagtctaattggtttataaagtcattcaggtcttccatttctgtttgtattctgtgtagttgctctctccatgattgaaagtaggatattgaagtctccactattgttgttaaatggtgaatttttctctttaaatctttaaatttgtcattttactgttgttagacacatacatgattataattgttttattttcctgatggattgatatcttaaaatattcttgtctctactaaaaattttgtctaaagtctattttgtctgatgttagcataggagctcaagctctcttttggttattgtttacgtggtgtatctttcttttcattcttgaacattcaatctatttgtttcctcgaatgtagagtttgtctcttgcagaactcctatagggggtcatgtttgtttgtttttccattttgtaaatatctactttttgattgaagtgcttaagccatttacatttagcacagtgactgataaggtagttacaatgtcactttgctgttggttttttaaaatatgatttatgtcttctaaatttctctattctttcactgtcttctttgggttaaaaagttatcttctagtgtataatttaatacccttgtcatttattctactatgtttgttgcccaggatgttatcattaacatcttaattcataaaaatctaattcaaattaataccaacttaattttaagagtatgcaaaattttgcacctatatagtttttgttcactctgctttcttttgtgccgttattgtctatggagattttttacattggatgcccatcaacacagatatataattattgctttataaagtcatcttttaaaacaaatgtgagagagaaaaagaattacagtaaaaatacatttataatctttttaaatatttacctatttaattacctttacaggtactctttatttcttcatctggattacattgctctctaatatcctatcatatcagccagaaggacttcttttggtatttcttgtagagcaagtctgatagtgataaaacctctcaatatttctttatctggaaatgtcaatttatcctgcatttttgaaggagagttttgctagaaaaaatagtttttggtgtacagtttttttttacgactttaaatatgtcattcttctcccttctggacgccatggtttcttcacaagaaatctgtggttaatcttattgaagatcccatgtaggagatggccttttctcacttgctgctttcaagattttctctttgtctttgtctttcaacagtttgatttttaatgtgcctagggtgtggatctatttgaatttatcccacttgcagttcattgagcttcttggatgcatagattaatagttttcatcaaattttggaagtttttggtaattatttctctaaatattctttcagtccttttacctcttctctgaaactcccattatgcctatgctggtactcttgatggcgtcccacagctttctggggctttgttaatttctcaacattctttctctttctattgctcacactgaataatctcaattgacctgtattcaagttcattaattatttcttctgatcatttagatctgctagtgagctcctctagtgaatttttcatttgaaagttttctattttctatttattttttctttttttgatgaaatgaggtctcactacgtttcccagggtggtctcaaactgctgggctcgtgatcctcccacctcagcctcccaaagtgctgggattacaggcatgagccaccatgcctggctaaaaattttctatttcttttctcatattctatattgtctaaagcatcattgtcatactttgctttagttctttggacactttgttttgttttgtttttagttatttgaacatatataaaatagttgatttaaagtctttgtctggtaagtttaatgtatgagcttacaattgacccatttccattgcccatttttcttcccctgtatattgtttgtaggagtttctttgcatatgccatattctttgttgaaaaccagacattttaaacacatagtgtagcaaatctggaaatcagattatttccctttccagagttgttttgttgctgctatttgtcactattactactgtttgcttgtttagtggctttcctgagctaattctgtgaagtctgtttctttgtcatatgtgataaatgaagtcattgtttgctcatcttagtagtcaggcaatgactgaacagagaatttcttaaatgcctagaaccaatacattttccagtctctggtgagagatctgtacgcatgttgcagaatgccatcaacactgaggcagtttaacactctcctttagtccccacttcctgcttgtgcagagcctcaaagtcgagctgaggtgagaccttaggactttctcaggtctttctttagcatgcgcatatacctgagcacatacttagccttttgcatgttcataatcttgtagattcgcaggcattttttaaggatttgcaaagcgtttatggacatgatgtttcacatcttctccttttaagtattttggattgtttgttgtttcttctgactgttgttactgcctgggtcaactgcaatgttaagcagttgccagtgattatttttagcaaataattgttttaaacaaacagagtaaatgctgtttccagtggatgaactctgagtcaattcaagccttactagtggggctttccatggtacttccaggcagatcgaataatgacaatcatctgaggatagagctttgaaacagctccactcccattctgatcctctagcagtaactaggctgctggttttcaccctgattgcaaactgttcattttcagggcttccagagagtggcagagaggagtacgggaataggaaagctaaaatgccatagaacatgttgttcttaccaatattcagtcatttaaaaaataaacactgtccacattgttgcaagtctttgctttatttccagagttctcaataagttgatgtgatattctttgccagtgttcccattgcttttatggaagacagactcttccattgttttcactctgccattgctgatgtccttttattcgtttcctcaatgtcttatagtttttacctatatacattgccttgctttaatagatttataactaatatttcacattttcagtgctaataaaatagtatttaaaagttttaatttccattggttaatcactagtatatagaaattaaattattactcatttaacttctatcaaacaaaattaactaattcacttgttatttctaatagcttttatgtacagtcatggaaattttctgagtagataattatgctatctgcaaatgagagtttatttctttccttctgattgttgtgacatttgttacttagccttattatctgtttttaccctgatttatatgttggattacttagttttcccatttgactaattttgttgtgccacccagttgtaatgcataacaacttctttccagtcatcacctgtctattttctgactagacagctatgaggtctttcttgtatgagtcatgtctatttccttgatcaatttatataatttagacatatctttgccatatgaatatttttcaaagaagaatttttatggaatgtttatcccaatgaatatctgttgttaaaaaattggcaagtagcaaaggaataagtaaaatttatttctatggctgtccttgaaatatttgatagtattctcacctcaaatcataattcttttatttgggatggatgattcacattaactctaggtctttagaaaacttgctgtaactcttttttatgaagaatttcttcaaatatgaattctttagcaatggatatgattgcaagctccaaaatttaaaactaaaatggtttttaaaggttataaaacccagcccctttattttatagataataaaatagatttcattatccccctgcagcagagcttccctttagctattattaaaatatagggagtgaattctaatttatcagcattgaaaggtacacctccacttctaataccctggtctgactgccaacatttttcacacatatgactgtaatatcctcctaactggcctcttggcttctactcttatcttcctatattctagtctcagaacttttgaataatcctgagatcacatcactcctcttctcaaaaccctccaatggcttcccattttactcagaccagaaatcaaatttcttacagtaggctattagactttgtatatataacaatttgtacctccatcctcccctctcccccagccagctacttgtctgacctaaccttctaataacctccccccttttattctgctccaggatgctagctccttgcacctcctctaacatgccaagcatactgatttagaggtctatgtgcttattaatgcctgcctggaacattttgcccctagatatacgtatgactcattcccattcccctgtcaatgccacattctcaatgaggcctctcttggacataacatccccactaaaatctagccatgctctccaacctgctctaatccttctgtttttcataaaatgtattgcattctaatatactatatgaatttctcattcattatgtttatctacgtgaatgcaagctccataaaagcaagggtattttgttgttgttgttaactgattgtacttttggcactcgtgaaagtgcctggcacataataggcttccaataaatacttgtgaatgaatcaatacgtaaaagaatgaagccaccctgacatttaaagccatggttcaggctttagcaacatcacagtgttcatcagttttgctgtctttcagttatggtaagtctttcaaaattatgaatggctagcccctgtttgttatgatctgggttctttgagataaaacacttccctagaggttatataaaatattttagacaatattttatcctgagaaagcaaattggataacatgaaatgcaggtaatttctttttttctccttgatatctcattatgttggcaaaaataggaaatgaagactgtcagttttccacggctgccatgcaaaagtactgcaaactgggtggcttctcccagaaagagaatgcctaggactatagcggggcacagaaagttccccacaaggagtatttcaaagctgagacattaggggctgtatgaggcagaaaaattggaagcagaggcaaaatgggaaccttagggctgagagagcctgaaggttgtggggcattaaaaattcatgctgtagattaacagtgtggggtgtaaaggatgctaggagaggaagaactgagcatggttagggatagttgaaggtaaagaaaaaacgggacacaggcccagcttccttgacaacattatctcttacctcataaataaaatttatgctatgaggagtgactttcctattcgtctttcctattccccaaataaaagcataggcacacaatggctttgctgtatttgcatgtattcttctcatctttcttctaagaatgacatgtccatctttctaccattccctctttgtttaactttagatcctggatccaggtcaattgatcataaatcatgttgcctggatggccaattaactgaaagaatattttaccatgttttcttatttcttgtaactaattataaattttagaacaatttgtgttggaaatcttctaaagatttctgcaaagttttagtagatttagttttgtcttcataacaccacttggaggaataattctttgcacttgtgccagctgcctgttttaggatagatagagtagagaaactctccctacgggaaagtcagagcaggaggctgcctagagcacatcttcttgtgggcctcagctcatggggtatgtggaagactgagactaatgggtagaaagagagagcctataagtgtatttttcttagactacatcagctgagaatacactaatgaagaaatatttttatatgtaatattttggttattttctcaaatatattatttaatataaatataacatgtaaatatatgaatatacacaaatatatgcatacacacactcacacacagacacatactctttttaggctcctaagtctcacactttgcttgtgagtttcttcctgattctgagatcactatctcagactacttcgtgtgctaattctcctctccatgttttatttatcagccatatcctcactctgtcccagtttcctccaagcaaccaccaaggagcagcagaaaacataaatcaaacattctttaaaactctatcaagacagagtgaaaactgaatagttaaaagaaaaaacacattgggaaaatggtcatttgatgattaaaattgctccaattttatttttttagaactattgaaataaacaattattgaaataaattttgttattaaaaatataacaaaaaacttggagtcggtagtttttctgctttattctgtctccactctcttgggcttatttgtctcagtaagttctgaaaaaatatttgccaaacaaataaaataataccatgtggattaaggttgatagctacatttgccttgaaaggtcacctaattcaaagtagattggtctttgaacctggttttcttagaagattttccctgaggcaataaaattctgagagtgaactatgatactattgatatatgtgaatgacacagaacctacaagtaggaagtcttcgatgagtcctcatttggagattttctagaacagacattaatttaactttagagagaacccaaacagatagcctggagcttggagctataacaggtgggatgtgagagtgaggaatcttccttttggcattgcaaatactctggaaattgcaatcagaagcagatgacaatcaaatttagggctgatgagataatatatctatggagttataaactagagagaaatttgacttgggaagggacttctggagaaagccatgagttcgatcagtaaataggctggccaaagtattcactttgacttaagtcctacagtgtccatggagataactatgattatttttgttattaatgtggaattagcaaactagagattgatctgtaaaagtttcaaagggcagtgacataaatatctttttaaccttaacatcttcaaaggaatatcacttaaatacttgtcaggtattgcttggtaaacagagacttcttatattatgcacatgtgtgtatttgcaggtttagagcagtttgtcggaagaatgcaagattttcgattataccaagtggcacttacaaacaggtaagcagatgttgcattgtaaacctcaagaaccgaaaggataaatgctgaattcacttaaataagaatactatgtagattataccattttttatctttataccatttggcaaacttcacctaattaatgtttacagtgtttgctttggcttagtctatggttgttattcactagtgctactcttgaggaactccttgtaatatgaaattgatcacatttttcctaaggatattctgtaagaaaacttgatatttgaacattttataaaacttgggatacaatgcttaaattttctatatgaggtagtttctattaacaatacttgagaaacttctacatctgccttttttaaattggtttgttgactttatacctactagagaatgtagaacaataaacgtgattaattattttgatacatgggaaattctcaagagactgatctattagacttggagacaagaagaatgagcatttgaagtattgtgatatatttttctattttcagtgaacaaataattatatagactcaggctagctttaatgacattatttccttatcttgagagtagatgggaaatctttcttagggcttcttaaaagcacacagaattttaaaaaatttaagtgaaattctgcttaggatgcctttgaactttcttcttcagcttatgatatcatggtataatagtatattgttgtatggatgagttgatcttatttacttctattaaaaatcaaaaagaagaatgttcattcatatttcttcaaggcagatataaattagtgtggtgggtttccaaatgagaagactagcccttgtaaatttagaagcattgcttttgatgtggttcttagtccatggcagatcattaacaatataaacattctttcttaccaggctatataatcaaggtatgcctcagtaaagggtgccatggccctggaacacagtgttaggtgtatttactgccaaaagccttactatattttagatcacctttgtctaaaatgctgaagggcaatgttgtagtaattctttgggaataaagtttttccttgggagtgaaagattttatactggattctatactggtagcttttggtcccattcaaaacttggtatcagttgaaaagaattgatgagatttaaagaaggtatgacttcatgtgatttaatgaatggaaaagctgcctgactccttcactgctccactggggtctgagaggaaaagcctggtttctctggtaagaccttgattactaattttggcctacctgaaatgtctgggaaggtgctatgtggaagaatgcctataaatagaatgactaattctggtctagaacaagtatattgcccctaatggaaaaattaaatatatctacctggaattggcattctttgactgttggcagccgccatatgatctgaagccaatgaagcattacaggatgtcaggatctgtactgatgagtcacaggaaaccattgacaaatggccttggcctcagtccttcacttaaaacagaagcagataaaatgatacttgctttcgtacttctttcccatggatgaactgaaaacattatctataactctcattgttctccatatattattgttcactctcagtagttagtttagcatcctaagtaaatgtgatcatttctatattatcacaaatagacacggtaaaatattgtggtatttaaataagtatcttaataatcagacaagggcttatgcatgcttcttgatataaataaaaagttaatattaaaatgtgtgggttttgatatacattttatgataatgaatttgtttatttggccaaaaataagttttattttatgtttcatgcatcaaattattaaaactaaatggatactcatgaaagcactaaacgagtgacattcatttgtaacgactcctagaagttctattactgttaagctctttgtccttacagtctccctcttgactcccacagagagattctggaagtcttctctggagatcttctcagattgcatgcccaatcacattgccgttgccctggcagccacccgcgggtccaccctttggcacagcggtactgcattcctaatgatgcaggagacacagctgataatagagtgtcacggttgaatcctgaagcccatcctctctcttttgtcaatgataatgatgttggtacttcatgggtttcaaatgtgtttacaaacattacacagcttaatcaaggagtgactatttcagttgatttggaaaatggacagtatcaggtaatgagaaacgataaggtgtacattaatttcctgtggttattgcaacaaatgcccacaaacttcatgtcttaaaacaacagaaatatattccctaacagttctggagatcagaaatatgaaatcaacatgttggcagggctacattcccttaaagattccagaggaggatccctccttgccatttgcagctcctggtggcccttggtgttacttggcttgtggcaccacaacttcaatctctgcctccattttcacatggtgtccttccttgtttctctgtgagcatcaattatcccttttctttctcttatataaggcccaccctattagacccaggatgatctcatattgacatccttaattatactgcaaagaccctatttacaaataaagtcacatttacaggtttggacagtagtacttggacatatctatttgggaacacaattcaacccactacaaggtgaaaactgaactaggcaattgaaccttgcctcaataaagtagtgtattataatgtatacaataaaaatatctaaaagacaacatgtaggaccttatgtttgagatttgtatcaaaatgatatttatgaaatgttgaaaataattatttttattaagtagcaaaaattaatacaaactaaggtgctttttctaaattaagaagtctctatatatgacatttatttcatagaagtaatgttctttgtttatgtctttatttgcatgttgatttataaaatccttgagcaaatgaacagatacacaattatagaatatgttgcttttaccacagggctatgaagtttctggatgtctaatacatatttgataactataattatgatgaagtgagccaatatatttgaatctaataattccatggtttgatatatactgatggttaaacttaaaactttaattacattaattaactttccattttcaggtgttttatattatcattcagttctttagtccacaaccaacggaaataaggattcaaaggaagaaggaaaatagtttagattgggaggactggcaatattttgccaggaattgtggtgcttttggaatgaaaaacaatggagatttggaaaaacctgattctgtcaactgtcttcagctttccaagtatgaatatttttaaacaattaatttaatagactgattggttattaataatgtacaagtatgctagctctctaggctggtggagacttcccttcaccaccaacttccttgaggcagattctcctaagtcttatccctaaattgggcttaaaactatgtttaaagttcttgtaaaagacattagagtgactcttatttcaatctcactgatgtttcacaatctgattttcagattgtttggcaagttatctatgtaaatagaattttcattatgttttcaaggaactgttttagtgtggctttctatgataatcctgtattgtttatatatgaaatatatggaatatgcttttcctagaatgaataatttaagcttttattgatactgtgtagtaatttctcaacattttgatttctgttttgccaaaaatgtgaatagattttcatgacatcgaatttctttcattaacagttttactccatattcccgtggcaatgtcacatttagcatcctgacacctggaccaaattatcgtcctggatacaataacttctataataccccatctcttcaagagttcgtaaaagccacgcaaataaggtttcattttcatgggcagtactatacaactgagactgctgttaacctcagacacagatattatgcagtggacgaaatcaccattagtgggaggtattattatgaattttgttttcaacaaggtttttgtcatacttactgtcttaacagcacattaagatgtcagagcaagccagatttcaagctttacattttgaaatgatttcatactctaagattttaggggaagatctgtatgtgagtcttttctctatataacattgttatatatatatatatatatatatataaaacgtattttataaataaatatatatatatttatatatacaggaattgattttcaaaagctgttgcttttagaagctatgatactctgaatctgacttagaagtgatttatccaatattttacttgatttgttctggaatataattttcaaatattctcaaaagcaaagagatggagctgaatttggagttgtaactatagcaccagagagtttttaagtacagatcttgatctacctgagttcatagtgcacagttccatgggtaatacttgtttttctttagtggaaagatctgatatgccctaagtagtttataaatgtctgatcataattgagaacatgactcacaatatttaaaaagaaatgacagctgcaaacctaggcagcatactgtctaatatagaaatgtacatatagagtatatttagaatggattgttctggaggaatgataggccttgtgaataaaatatgtctttaaaagcagaccaaaataccagtatataagcattgtttgtttgctaagtcatagcataatgaacaaagcaatactattaaatattcatcatctaactttggaaaaaaaaataaaaaaattgaaatatgttaactgcattctgcagtttattgtcaactttatattcttttttctttcttttttttttttttttgacaggcttttgctctgtcacccaggctggcatgcaatggcatgatcatggctcgttgcaacctcgacttctgggcctcaagtgatcctctcatctcagcctccaaagtaactgggactacaggcatgtgccaccatgcccagctgattttttttttcactttttgtagagatggggttttgccatgttgctcaggctgctctcaaactcctgacctcaagtgatctacccgcctgagtctcccaacatgctgagattacaggcgtgagccaccgtgctcagcctgaactttatattcttaactgtattttaaatagtgtagtaaatgccttcccttggtacgtggttggtatagatataaaaaattccatttccctttagaggttggcttgaaaattatctttacaatacacgggtttggatattggtgacagtccttctgacatttccagataaattaaaaacgtgtatggatatccacacgattaaggagaaactgattttgtatcaattaaatatacaaaaatcttccctgttaaattcacataatgcatatagtcctaggaccttaaatatattcacagttgagttggtgttccttaggagtgtgtgatgctcatgtttgcagatgtcagtgccatggtcatgccgataactgcgacacaacaagccagccatatagatgcctctgctcccaggagagcttcactgaaggacttcatgtgagttctattttatgcatggaaatctaaaaaaaaaatagtagagatggtgactataaattctatgaacttaatcttggcctaacaaatgaaaataaatttaaaaactgatatgaacttaaaatgtcaattattgcagattttttaagaaaaataacagccatcaattaagttgaaattgtagtttttaaaaataatttcagccagagaaattacaactgaaaccaaaccctaaggttcttttctcttttgtttttctttctttgtttcatcagcattatcatgttttataaaacaatttttaatgtgtttggatagcatggcactaaacaaaaaatagtttgattcttactaaagggtatttatacaaaagtatcaataaacaaaagcatcgttagatgaagaacaatgtttatgtatttatgtcaatcaaggttcatttattgctaatatcaggcattttaattaattgaaaatctatagtaaaatgatttatgagttatgttactttagttttctgtgacgatcaggggaattccatagttgaggtggaattttagcttcatctttagggaaaagaggtaagtggaaataaaatcaagaaacattcgttggtaggaatatctagcaacaacatcagaaatagctgatatgaaagacggttcagcagcagtaacaattataccaataatgagagtagataatatagactcttcagtaaatatgtttaagacaactggctgctaatttgcaagaaaataaaattagagctctactgattgtatgtacaaaaatgtatgtggcttaaacttttagtgaaaaataactataaatatattaaaataaagattagaattctatatcttaagttgagggcttttatcagctaagcaaatgaaatacaaacagaaacaaacatctggagctatgaaggaaattaatgacatattctgttatataaatatttaaaattctacacagtataagggttaacataaatgtaaggtagtgataaatgatggattgatagaaaatatttgcatcatgttaacaggtaaagagttaagattcctaacacacaaacatttacaaaatattaagaaaaatataacagtctgataaaaatgagcaaatatatgaacaagcaatttacaaatgaacaaattgtaactttaataaacatataaaagattacccaacctcagttttaatcatattcaacaattgtttttaacatttcaaattagcagaaaatataaagattggtaatatttagtacttgtgggaatataacctttaacacatcactgatgggattgccaattgacacaatagttttggggaaaatttgtccacctctactaaaattaaattttcaaatatagtgaactacattatataattgctgtcattctgaaaagcagttcttcaatgacaagtgtatggaatggtgtattagtctgtttgcattgctgtacaggaagacctgagactaggtaaatataaagaaaagaggtttatttggcttgtggtactgcaggctatacaagcttggtgccagcatctgcttggtttctggtgaggcctcagaaagcttacaatcatggcagaaggcaaagccagaagccagcctcttttaaacagccgtgtctaaacagccatgaactaacagagtgaggtctcactgctgaagggaaggcacttcatgaaggatccacctccataacccaaacatctcccaccaggctcacctccaacactggggatcacatttcaacatgagatttggaggggacaaacatacaaactatataaaatgcttatatttctatcattttgttacataaatatgggcttatatgttagtgcattttagcttttcagatggtagcactgtctcatacactcatgtatgacttgtgaacatctctgcctcttggaccttgccctacacttgtgttttagttagttacttcacttctctgtgaaatttattttaggatattatagagcatcttgctttttaaaaaaccatctgtaaaggttttggcaaattccatttctgtcttctgattcttactctgatctaatttgcttttgactgtaacattagtgagaatagttcaatggtaagaatattatctataatgcagactttctctagcacattcaaaacgtagtcccactcctcagtttcaactaagagtctttgatttagttatggcctactttctttctttctttctatgtgctcagaccaaaactttcatgttctaatttagatattcttttgaatttattttctagatcactactttatatacatctagtcctcaccattagtcaatacttgctttaaaagaagaaatcttttatggttttcttttggatttctaatgcctagagtctttgcatttgatttcattagtatattatgaggaaaaatcttttagaagaactgattttaatatgcttgattgtatggcttatcatattgtcacagaaatgaaattaattggattaacttgattgatttattcttcactgagccataattgtgtgtttaaatttttgccaattttatttgttctagattttaaagttaaagcaacatttattatatttttctactgtcttcttttgatcccttaagatggacacttacttccttataatcagtgatttctttcattaaccttgtcctctcctccacaaagccactaacaccccaattaaaaaatgctttgggatgaatttagcagggcaccttgaactgaatatgtctagtatttgcaagctacagtttggctaataccttcatatgatatgttcttttctgagcttctcttgctttctgttgactagtcagtcggtattagtctctctcatttgcttgtgacgtcctgtcttgttttatctttctgtctttaattgctcacagttaagtgttggatattttctgattcttggatgatttcatgcttccccttaaaaatagagccattaaatgaatgaaggctcatgattggtttcagaagacaagttgggattttcagacttggtctcaggtggtgaatgttggattatgaactagtgaattaattaactataatttgggttgagaatacattttaatgcttcttatttagaccttaagtaccttttgaaaacaaaaatgaaaaactaaactttttttgttattttcctccttgacatattttgatagtttatgaatttagccataaattttaaaaagcaacaaatataatttacttagcaaactttggcaaatgcaaatgcagctgcagggaaaaagtcaatagactgttaagttgaatgatttctcagtcctatgatattttcaataatgtgttgaaaatgaaaaatgattttatagaaacattcataggcatgacattctcctttgttaccattcaaagtattttaatacaagtagagacttacatatctgagaaaagtcgtcttacggtaatttgaaaatatacctattctaatgcttttcttgttgttctactttttaaaattatacgttttaatataagccattcacttcctattgggatccatgttctttttaagacctggacataatccaaaaagaatgtcttcaattccacagtgttatgctatccattaataatattacttaataaacagggcttttgtgaattatattacagacatttggcaaacagatgaaaatgtaaggactgaaaatatgccaattcttggcaattgtctttcctatgagaaagtgtttttagtagaaacaaaaatgaatgaagttgagaaaaggtgaatggtgaattcaggggcaggttcacatatttagccatcctaaggaattttccgtacaaaatactattcatttgtttataaggtcaatgtcacaaattggtggctcacaggtagaaacagtgtttaaacagttttaatttaattttctgcaagagttttcactttaaaatatttatttattcttcaatcttttttatttatttatttttttgagagggagtctcactctgtcaccgaggctggagtgcagtggcatgatcttggctcactgcaacctcagcctctcagcttcaagcaattcttctgcctcagtctcccaagtagctgggactacagctgcacaccaccacacgcggctaactttttgtatttttttttttgtagagatgggtttcaccttgttggccaggcaggtcttgaactcctgacctcaagtgctccacctgcctcggactcccaaagtgctgggattacaggcatgagccaccactcctggccctcaacttttattttaagttcagaggaacatgtgtaggatgtgcaggtttgttacttaggtaaaggtgtgccatggtggcttgttgcatagatcatcccctcacctaggtattaagtccagaaaccattagctattcctcctgatgctcttccccccacagcccccaccatccctaagaggccccaatgtgtgttgttccccgacatgtgtccatgtgttctcataattcggatcccacttgtaagtgagaatacgtaatgtttgattttttgtaccggcattattttgctgagaataatgacttccaactctattcatgtccctgcaaatgatttatatttctggtaatacacagtaatgggattgctgggtcaaatggtatttctgcctctagatctttgaggaatttccacactgtcttccacaatggttgaactatttatactcccaccaacagtgtaaaggtgttcccttttctccacaaccttggagcttctgcacagcaaaagaaactatggtcagagtgaacagacaacctatagaaggggagaatatttttgcattctatccatctgacaaaggtataatatccagagtctagaaggaacttaaacaaatttacaagaagaaaacaaccccattaaaaactgggcaaagaaccctgagttagcgagttgttgccaggggaggacattaatgtcttcttttgagaactgtctgttcatgttcattgcccaatttttaatggggttgtttgtttgagaacagttctcaaaagaagacatatgtgtggccaacaaacgtatgaaaaaaagctcagcatcactgatcattagagaaatgcatatcaaaaccacaatgagataccagctcatgccagtcagaatggcgattattaaaagttaaaaaatgacacaaatttttaattcctcacttctcttaatcagaacatagtctaacactgtgtccatttcctgccatcaacaactcactgattcagggtgacatttaccacatttacaacagtatcactcttgggcttgctacaacattcactactatgtatatccttatacatgggcgacatcactttggtgaactacctggccttgaaagactcggagcttcttaacctcctaaagcaaaactgatggatagattgagacactagaagctagaatacatttttaattattctgagtagagaaagaccagctgttcattgctatattcattgttaactcctatttcttttacccctttataaaaataaaaactcacaaataaccgaaaacaactcaagaaaatctattagcaaagacactgtttactctgagatgaaattaaagccatgcttactttttttttaattacatttttgacatctaaaaacatttaccttggggagcctcactgattctcctctgcactctttgaccaggaactccgatacatttttgtattgtactggcaattttaaggccttgactttaatgtatgatacataccataaatacttcactcatagagaatacttttagaatacttgtcgcatttctttccaagaatgaaaaaaaagcagtaaatgcttaatttactaggctcactttagaactgatttagggtgaaacaaatccaaaagcctagatgctattcattaactttcatacaaagttaaatatttcaaagtagaaattagaaatacatggtattgaacttgcatgaatcattatatatctcacaagttacaaacatgttatttataaatgtttaatttcatttgaataaaaaatagccactgttacttgcatttttaagtaaacttttaattttgagataattatagatttatatacagttgtaaaaaataatataaagacaatttgtgtactctaccaatttgtcccatggtaacatctggcaaaactagtgtttttttctttttacatcaaaagtgtgatttgtgtacaataaaatatacccacttaaaaatatatagtttgatgagttttggcatatgtgtaccctgtgtaatcaccatccctgtctagagatggaatgtttcactctcccaaacgttctcttatgcttctttgcagtcagtgctgtctctgaacccccaatcccaggaaaccaccaatcttatttctatcaatacagattagttttgcctgttccaaaatttcttagcatagtgttatttggtatgtaatattttcgtacataggcttttaaatcccacctcacccccacttttagatcattccctaattacatgtgctgttagctttactgcaacatggtatctctggcccacttaatcagaaatccattataagtatcaaagtgtatatattaagctcataggtacataatacaagctaggaattggaagcctgggtttatctgtcaactaacatatttgcaaagctataatatatttattacttctttttcttatctagtactttctttacttgatctaagagttcaagtgttgaatagaatctagttttaagaaaagtgttgtcagttgaaacttgaatccttatgagttgtctttttcctttaataactacatttacctttcggggctctggccaagagtgatgcaatgatcagtgtctcagccaagcattggcacttcattggctacttagctattctttcgtcattttgtgacatcattacctgcaagggtagccaagccttcacagagcaatttattagtaaccatgaacacttcttattctttggctctaacttatgacccttttataacattaatcatagatcttatgaattaactacaatcaaactatcagtataaatttttgttagcattataaatagcacagccagcttgaaactttttatataataagccttcctaccactcaataatttgaatggtgccaacatcacactctagaatgcttattatataaatgaatatttctgttatttttgaaagattcctttagagcaccaaagtccaaaagtatgaatcatcatgactaatttgtgtcatatttatattatatatcaggctttaccactgcttattttttctctgtttgttcgcagattttaccctaaatatattttatttatattttaattattgtaatgctagtaaattaattcatttttatataactagcattcacacagttcatattataggatctacatttgatatatgtttagtaagtcaaggtaaagaattttctttcctcactgacatgatgatattattaatctttgaaaaacacttgtactagttctttccgtgagataggtatgtgcataaatgcttttaaaatataagttgaaaacatgaaaaagaggttatgagcatggagataaattaagacagccttacagaagaagcaaatagagatagtgaaagtataaacatagtaaaagaaaagataatatttgaagggataagagtaaagaattatctaaaggtgaggaatgacatgatttttctgaatcccaagtaggctaagaaaagtaaatgcatacataggtataatataatgaatccaataatcaccaaagaccaagcagccagaaagacagaaatctgataatcaccaaagacagaacagcatcctaaaaacagccagagagaaaaatacaaagtgtaagaaattaatttctaagacactactgatatatttctcaacagccacaatgaaagccagaagacagcagagtagtgcctttgaaatgcagagagaaggcaaccaagaaatatggaattgtatttgtagtagtaccatcaattagaaacaagaaagaaagaatgcatttttagtttacagatatatatatcaatattatcaccagcagactctcaataaaagaatttttcgagaatacttttcataaggatatataatgtttccagaaaataggcctggtgtgaaggaaggaattgtgagcaagtaaaccagcaaatatgtggataaatatagaggaaaatttactgcgttaaataaaaataaggttatatgtaagaaagagtataaaaagtagcaggataccattaaatggtcattaaaaatagcatttaaagggaaggggtaaactccaacttcagctccctctagccattctgttgcaccttggggtaagaagagcagttactgagaaatacttgtaaagttcacagccaatgagcacagggctcattaaaaactgaaaactaatcctagaatcatagaacaggggtccccaacccctgggccactggtcagtagtggtctgtggtctattagaaaccggactgcatagtaggacgtgagcagctggtgagctatcattacttcctgagctctgcctcctgtcagatcagcagtgacatgaagttgtcataggagcataaaccccattgtgaactgtacatgtgagggatttaggttgtgcactccttctgagaattcctgatgctttgaggtggaataccttcatcttgaaaccattccccatgtgctgccctcacacccagttcgtggaaaagttgtcttccacaaaaccgatccctggtgccaaaaatattggggaccactgccatagaacgctttccctcccctctcatcttaccaccacaccatgaaaggcctgtttgccagagttccctttactcagtacatcatgtctggatttcaacaaaaagttacaaagcacactaaaacaccaaaaacaaacaaacaaagaaacaaacaaacaacctcacagtttgaagagagagagcaaaaatgagaatgagactcagacatggaaaggatatggaaattatcagaccagaaacttaaagcggctctgatgaatacactaaaggctctaatggaaaaagtagacaacatgcaaaaatagatggcaatataagctgaaagataaaaattctgacaaagaagcaaaaagaaaagctagagatcagaaacactttcatagaaataaagaatgcctttaattggatcattaatatttggggacagctgataaaagaatctgagtttgaagatgtgtcaatagagactaccaaaatagaaaggtaaaaagaaaaatgactgaacaaatagagcagaatatctaagaactgtgagacagctaccaaaaatgtaaatacatataatggggaagaagaagaagaagagaaaggaacagaagaaatatttggaacaataatgactaagaatttttcatattccaaatgcagaaaaatcaaagttagggaaaaatatcttaaaaggagcctggctgaagggggaacatctagcctatgaaaaagcaaagataagaattacattctacttctcctcagaaagcatgcaagcaagaaaagtggttaaatagttaggtgttgacagaaaaaaaaaaatccacctagaattctgtatcttgcaaaattatcctttaaaagtaaaggaaaaatactttctcaaacaaaaaccagtagacttttcttgccttgcaagaatgttaaaggaagaacttcagagagagagaaaaaatgatacaggtcagaaaactcagatttatgtaaagaaagggagaacattagagaaagaataaataaaataacttttatttttcttatccttaattgatctagtagataccagtttgttcaaaattataataagaacaatgtatttcattattatagcatgtgtgtaagtgaaatgaatgatagcaacaatacaagacaccagagggaggaactaggaatactttattattattaggtactcatgccaccttttaagtggtatcgtgttatttaaaagtcaacttggaactctcgcatgacattattttgtcttgatagttcaagctccacctgcggttctcccgtcctccatgccaggtgtcaggggctgctctggatgttaactcttccgccccatgacttccagttccaaaatggcggcacagaaacaagctgccatgccacaaccccaccgcgcccctctcccgccaaaaagaaaaattaacaaatatacattgctgagattatcaccagaaattgtcacgatagtccagaactcaaatatgaagatataactgttcccagggccataaggaaatgagaaacaccaagtggatggtaagaaacctgactttcacatttgtagcactcgttaccccattttgcctgacaccaaatatgcagaagattttcctccaactcacttttttctacactggaaaaattaagattgaggtaaacaaccagcttccccagccattctgggttaccggaaagagacctgtcctatccatgcctcaacccactggaagcgtcatgagtgcctaaagggagacatattcctgaagataggcagagacaaagggggatgtaggtctgtcatccccagcctgggaaagtctgctctgtaacttgaccaatgcagacacaatgtcagagtagctgcttagcagcactatgatgcaggaggattatttcactgttctcctcggcacaaacccttaggcagccttcccatactgtcaggatattccctttgggacctctcttgttaagaagggcacaattggattgtttactgaagccaaggcgaacctgggcttaaagcgccccctatagctccctagaggaagcaatttagcagcaaagacatagatgtatgtccacaagaaaaacagcagtaggaaactatgatgtctccaaacagacaaagcagggaaccagggactggccctaacaagacagtaatatgtaagctccctgaccacgaattttaaaatgcagttttaagaaaactcagtgatctccagtagaacacagaaaaataattcagaaattcattagagaaatttaacagagattgaaattttaaaaaatctatcagaaaccttggaactgagaaataaatttaccgaactgaaaaattcactagtagctctcaccatcagaatggattgagcagaggaaagaatcagtgagcttgaagacagaatatttgaaaatatatggtcgaggagaaaaaaagaacacaaagaaatgaagatttcctacaatatatagaaaattattaatacctcaaaaggccaaatgtaagaattaatggtattcaagagggagttgaagaggaaggattagaaatcttattcaacaaaataataacaaaaaattccaaaatttaaaagtatacttggattagttataaatgtatattataagctttatagggcaacccccaaaaaagttttaaaaaggtatagttgatatatttaatacttacaaaggaaagaaaatggaaccatgtaaaaatgctcaactaaaaccacaaaaggtaaaaagtatatagaaaacaagaatagaaacaaagaacaagggcaatgaataaaaagtagtagatattaatccaactatgccagtaactactttgagtgtcaatggtctaaatataccaattaaaagagagagattgttagaatgaattgaagaataaaaccagctcattttataatgccaacattaccctgtaccaacatcagacaaagaaattacaagaaaagaaaaccacagaccaataactctcataaaaatagatgcaaaaattctcaacaaaatattcaaaataaaactattaagcaatgtgtaaaaataattatatatcagaaccaagagggatttatctcaggtttgcaagactggttcagcattcaaaaatcagctaaagtaattcctcacatcaacaggctaaaggggaaaaattacaagattatatcaataaatgtagaaaaagtatttgacaaaatcaagcatccattcatgatcaaaactctccacaaataaggagtagaggagaacatactcaacttaatagaaaatatgtataaaaacctagagtgaacatcatacttaaggataagaaaccagaatctttcctactaagatcaggaataagacaagaatgtttcctctcagcactccttttcaacaacgtattaggaaggaataaaaacaacaacctcatttcaaaataaggcagtaaaggagaacgaaagaaaaaggatatatagaaaatagaaattccaaataaataaacaatcacaacaaatctaaatgtgctgaacatattagaattatgagactgtctggctgaaagagaaaacaacatccacctattgtctgagcagaggctgaattagggcaagagaatgtcttaatcacaaactttacaaaagcaccaaaaacaccctattaagcaagatctataatatttttatgttatatttcaaaaagtcaaatgatttagaaatgtataattaaaaatcaaaattttaagtaaagacacattagtgttgcttgttttatggtcctgtgttattttgtaatgggagctgttgtttctaatcagtccataattcctacctaccagttttataaggttggcatgtacctgtctcatagaaggttttacaatcgtctagaaacagactaggcatgatgggacattatacacagctatttttttaaaactgtagagtgtttattaactttttccatttggctccaaagattggtaaatattttctagttgtatacagaggttcgtatttttcctttgccctcatgctgcaatgcagctcagcatggtacttgtgctgagggtgtgagagacatactcaaaaaacaagcacacttcaagtttgaaaatttaagaaagctagcatgagctacataaatattaggcaaaacagacattactgtttcattaaagaaaaagaggcttattgtataattataaagtataaaattctaagtttacatgcatctcataatatagtttcaaaagtataaagcagaattttatagaaccagaaagagaaattggcaagttctaccatcagcatagaagaatttaatacatctcttattaaaaatgtctttttataaaaagaaagaaaagctacatactagcagttgtcattagcaagacaacacatatataactgacaaaggtaacatttaaattaagcaaactatttgaaaaacagacaaaagaagtgaacaagtaattcacagaagaagccagaagtggcaactgaaatggtcaatatacatgtaaagacatgtgcaactttactggttatcagtaaactaaaaaaaaagaatgtgataatattttatactcatcaagttgtcaaagatggcaaaatctggaaatttcaggaactggtaagtggggactcatacaccacttatgggaaggtgctgctgcactatggaaaacaatttgcaaatgtctacgtggaacactttacagtagtggatatgaaggaatatagctatcacatcaacatgaccagacttctcaaacaatcatactacagaaagcttgttttagaataatacatacactgtatacacttatataaattttaaaatcatacaaatagaaagaagaaactgataaaaggataggaggcaggactaacttgcagctccccctcggacagacagagcagcatgtgaagacacacatcatgaacttttctccaagaactactgcagcaacataccaggaaagccacgagaatccacagatcctttgaaggaaatagattgctgctgcaggctccaggagacagccgaaaaactgtaagtgcccaaagtgtgaaagggggatcttccacccctgaacacatagccttcctggggaacctgaaggtccaggtcacaggtgatggatttggccttacctggagctgagacaaacttagagagctgaacaaaatataagggtaaaggaagcagggggaagagccctgtggactctctcagcccccaggaaaaccatttctgactttgtctcctagggtccttgggtaggactgccagtggaagtggggaaagaccacaaggagaaggaaacttccagatgaactctgtaacaatttcgactgaatgccaactttcctagcagaatctgggggtgagggtgaactgggagtgcagacacagcacagaagttgcatcaggcagggaggtgtgaaacctgaaacccctgcttgcttttccagtggggagacctggagcaggggcaagtcctcagccctgttcacccattgcctggaaataaactcagtgctgttgtggagagtattgtgggagtgagactggccttttgggttgcatgggagctgggtgaggcctttcactgccagctttcccctactttcctggtgacctgtatgatgtagcagaggcagccataatccccctagaaacataactccatcgccctgagaaccacacccccaacactcagagcagcttcagcaaggcctgcccaaggagagtctaagctcagacacacctaaccctgaccctacctgatggcctttctctacctgccctcgtagccagacaaaggacataatctcttgagagctctatggccctgaccaccgcctgagaaacttatccaggagactctagagcaagcttgtatcctccctatgctactgccgttgatgctctcttgaaagcgccacctcctgtctgaaggccaaccaacacaaaactagtgcaataaacaaaaatacaacaaaggaccctcacagagtctacttcactcccctgctatctccaccagagcaggtgctggtatccagggctaagagacctgaagactgatcatatcacagggctgtttgcagttactccccactaccagtctggaggctgctagctccactgggtggctagatccagaagagaaacaacaatcactgcagttcagctctcaggaaggcacatcctggagcacccacatccagggagcacccacatctagggaacacccacatctggggagcaccctgtgggaagaaagaatctgaacaacagcacttgagccccagatcttccctctgacatagtctaaccaaatgaaaagcaacctgaaaaacagttctagtaatatgacaaaacaaggttctttattatccccaaaagatcacaatagcttaccagcaatggatctaaaccaagaagaaaactctgaattcccagaaaaagaactcagaaggttgattattaagtgactgaaggaggcaccaaaggtgaatatgaactcaaaggaatttcaaaaatgttacaggatatgaacagaaaaatctccagataaataaatagcataaataagaagcaatcataatttctggaaattaaggacacacttagaaaaatgcaaaatacactggaaagtcttagcaatagaatccaacaagtagaaggaagaacaccagagcttgaagacaaggcttttgaattaacccaatcaaacaaagacaaagaaaaaaaaaaattaaatgaacaaggcctccaagaagtttgggattatgttaaacgaccaaatctaagaataattggtgttcccaaggaagaagagaaatctaaacgtttggaaaatctatttgagggaataatcaaggaaaacgtccccaaccttgctagagatctagatatccaaatacaagaagctgaaagaacacctgggaaattcatcacaaaaaggtcattgccaaggcacatagtcatcaagttatctaaagtcaagatgaaggaaggaatcttaagagctgtgaggcaaaagcatcaggtaacctatgaaggaaaacctgtcagattaacagcagatttctcagcagaaaccctgcaagctagaaggaattggtgtcctatccttatcctccttaaacaaaacagttattggccaggaattttgtatccagtgaaattaagcttcctaaatgaaggaaaaatacagtctttttccgacaaacaaatgtttagagaacttatcaccaccaagctagcactacaagaactgctaaaagcagctctaaattttgaaacaaatccttgaaatacaccagaatacaacctccttaaagcataaatctcacaggacctataaaaaaaaaacacaatttaaaaaaaagcattcaggcaacaaatagcatgatgaatagaaaggcatctcacatcctaacactaacattgaatgtaaatggcctaaatgcaccacttaaaagatacagaatggcagaaaggataagaactcaccaagcaagtatctgctgtcctcaagagactcatctaacacataaggactcacataaacttaaggtaaagaggtggaaaaagatattccacgaaaatggacaccaaaagcaaacagcagtagctattcttatatcagacaaaacaaacttcaaagcaacagcagttaacaaagagggacattatataatgataaaaggactagtccaacagggaaacatcacaattctaaatatatatgcacctaactccagagctcccagatttagaaaacaattactactaaacctaagaaatgagataaacagcaacacaataatggtgggggacttcagtactccactgacagcactagacagatcatcaagacagaaagtcaacaaagaaacagtggacttaaactatgacttagaacaaatgtacttaacagatatttacagaacattctacccaacaactgcagaatatacattattcatcagcaggtgaaacatcctccaagatacaccatgtgataggccacaaaacaagtctcaatacatttaagaaaactgaaattatatcaagtactctctcagaccaccgtgaaataaaattggaaatcgactcaaaaaggaaccctcaaaaccatgcaaatacatagaaattaaataacctgcttctcaatgattcttgggtcaacaatgaaatcaagatggaaattaaaaaagtcctttaactgaattgtttgatatagtgacacaacctatcaaaacctccatgatacagcaaaggtggtgctaacaggaaagttcatagcattaaatgcctatatcaaaaagtctgaaagagcacaaatagacaatctaaggtcacacctcaaggaactagagaaacaaaaaccaaacccactcttattgacttaataaggaaattaaaaaaagtatgctgagattgctaagatctattataataatgaatcttctatctgtgaaatagtgaaaaaaaaagaaattagtgctagatttgctgtcaaaccacaaagtgcaaaagttacggccgcagtgctagataagtgcctagttcagattgaaaaagcattaaatttgtgactggaagacatgaacagaaaatatgtactatatggaaccaaaatatgtactacatagtacacatagtaccaaacccagttgctgtcacttggcacatagagatctggcatctactggaggtcttcaaatgtattccttgtggaaaacaggactacttactatactactaaattcagatattattagcggagtggaatatatatggcagtatcttgtttctaagttgagtggtacataaaatggtacaattctttttttaattattcataaatttatttttaatatttcagtataatttcccttaaacacaataatatgattgattaatctatcaggaatgtatcacctatgtaaatactcatgctactactaaagacagagtggaggtgactctattcacaatggaataaccattactaaattcatgattactgtgtacatttatagttttactgtaaagattgatcatttgctagctttagtcactcaacaaatatttataaatgccttctatgtgtagtgcattatgctagagtacagccattatgtcttgattacagatgcaagtatttgaaaatattgaaggaccttcatttgtgaaattcaaaaaagattccctggcagacaccaattactataataaatagagatgacttcagtgcaaacaaatgattcaggctaacaattagtaattaacaaataatataaatagtatagacattttaaatcttaaagaaaaatttaaatgcagcaatacttaagaaagggttttttaatttactaatgtagtaatcaagtctaatactacaaaaaatttctaatatgaaataccctttatatttaaataatcaaataccttgtataccagttgactaagtttagaggaatcttaaatattaaaaaacatcaataacgccttatacttcttagtatgtgaattcgtatttgtatgatgtatattattttggagagttgcctgtaagcaccatattaatataatgaatgaagcttttcttcattgaagtcctttgtaaaataatgcaggttatcctgaataaatatggtctctattccaggccatatttcctggaatatcaatagggttaaattattatggttgcaataaaatagaattgctttatcttgtccactatctacaatcttgaataaactttaaaatcctccttctgttctcttaagggaacgtggtgtgtccccatgtgtcttttttatttagtgccctgaacaatccataaataagaggaagaaggaataaagaaggacagagatttcaaaggagaaatcaaatacctaacaacatgcagtattgaaaattaacaaataagaatgcaaggcctctcatgcaaatggttccatctcattcaaccactagacataattacttctgtattcacaaggcctacagtaaggaaatactgtttaaaaaaataggctatcaattatatttatatatagacaacatgtagactgaaggattatccgaataatcctgcctagagtttctgtttttctaaatataggttttatgtcacgtattacaatttgtttcattggataattttccaatcttccatttcactttacccatagaattagactaggcattacttgaattagaatgtttctaaaaatagccacttatattaatagttgaaatattgaagtaactatgtatgatgtgtttgtcgtcattgtattgtcacctatgtttgatcagtattgtccaacagtattagtagttatttattttatgctattaatttcagtatctagagagtgagtaagtacattgtatctgtgaacactttaattatgtaagaatttctagccaagggaaagataattactgaaaaagggatatgtcattgaaggataaacacgtggcatttctgtcttctcagtggtaaagaatagtatttgttttggcttttccaattgaaattacataatctgtaggtaaaaattcacaggtgaagtattattgcatttgcctttaaacctttaatgttactattcaattaaatgctagtcacattaaagtacagtcctgtaatgtgtcataaatgcaatgagtctgttaggacattcactcacacattcaccaaatatatatgatcacctcccatgtgcaaagcacagagccattttctgtctagattctctatgtagttgggcactttatctgtgttcccctctgaaatctatcactgataataaattaacaagtttgtctaacattacctttgccatgggaacattagagctacctagggacacttccattggaaaaaagatacctgagtacactaaagtttttatgtttataaagatgatttctctacctagtagacaaatcacagtgaaactggatcctttgaattaccatggaattgctccagccagaggaaaggggaagccttgaatagagccggaggacaattactattattagagatttaggctcttaacatttccaacatagggggctggtttctactgatgagaaagggaaaatgtacagattttcagagggtctgcaattcattcaggccatctgggaatagttaaaaaaattacctcttttattcagtgagcagtactgtaacagtactaaaaagtgatcattttataatctttcactttgaagcagattgtctttctctccttctcacataggcagtgctgcatccatatctctaaattttatagccaggagtggaataactacatcttttggtttctagggctttgctgtccagtttagactcagcagaaagtaaagatggactgagccagagtgactccagtcaacacctctctccctcgaatactattttcggtccctgaagccagtataaacatggagattagaagtgaggtctttgaaggaaaacatccagatatataaattgagtacctactatgttctagggctccttctaggcacttcttcaacatattgaagacaagttgttttcgatgactcattgtgatcattatgaacttaagcttccaaaggtcattgacactgggagctctcaggaccttgaagggaaattttctccctagcccccagccttttgcaaggacttcatatatctttgtctaagaggatatttttcttccttcttttttcaaagatacatagtaggcatttaagattgttgtataagtgactgaataaataaattgctcttgcagttaaattacttaaacttgtattttacacaagtttctactttctctgtaaatttgaaggtgttaagaaataagtaaaattgagtgtgtggcttgtcatggtggctcccgcctgtaatcccagaactttggtaggccgaggtgggcggatcacttgaagtcaggagtttgagacgagcctgggcaacaaggtgaaaccctgtctctaccaaaaaatacaaaaattagctgggcatggtgatgtgtgcctgtagtaccagatactcgggaggctgaggcatgagaatctcttgaacgtgggtggtggaggtttcagtgagcccagatagtgcctgggctccaacctgggcaacagagcaagactctgtcctttatctccaaaaaaaaaaaaaaaaaaacattgagtctatcaggagtggagttgataaaaatgctttggagactatgggttatctttgaaagattgtctttgctgctctgtaatggtaacgaagaaacactatacttcagtttaatgatccataagaaataactgtcattgtgtattattagaatataatgtaataaaataaatttcatcagtgtcttctagattcaatgactattcaatgattttcatacctgaacatgtcaaagtatttggctgcaacttagcggagttgattagtagcctttaagaagctatcaaaatgaaagcagttaaatgaatcagtggtaaaggtccttgaccctgatatagccattgtctaatctcataatttgggcattcagggacatatcgggggaatccagttgttacagaagaaaccgaaacataattgaaagtgacaaatgatcaactggagattgggaaaacatgaaatagaaaaccatttgcttcaggagctgcctaaaatataagatacacacagagttcttgattttaaatcaaactttaaaatcactggtagaaaaggcagttgaaaattatgagaattcaaaaatttacttataatgcacttaccaattattatttcttccattttgtcatggttatccttgtattatctgaaacgagttgttaagaaccaattatgggaccaagaatttaatacttcatgaaactttataatcaaagaatagactacaaagtattccttctgtctttgcaaaccatacaaaatgataatagaacagtatcatctttaggatcaaagacccaaataggcattggtgtgtcatttagttgcatatgtcttaaatcaaattttaaaacaaatttaggcatcatctctcaaaatctttgcttctgtatattaatcccattgttttggaaaaaatgtatattttttacaaatcatactctgtttactggtggctcaaaaactttttagcttacatagtagttgaaaagagaatcattttttctgcagatttttgctcatctgtgtgtaatttaaaactgaaacatattaattttcttaggttttcttagtgaaatgttacatgcaaatgatgtataattatcttgtaactatccatgcagttacattttatttgctctcaatttttaatacattagtaataaatgtacactgtggaaaaaataaagttataaactttatctgtaaacctaccacccaccggtaaccccagccaataatcttagtttatatactttcaggcattatattattgttattattagtaaacctgtctcatctgtctctatcttcttaaaattgcatatttatatctatagataagtccacctttatctagaatagaggattatactctgtatattatttttaacttgattttcaattcaagctgtattatgaatatatttctctatttatatttataaatgttagcctttttttttttaggaattggaacatcttaaaccactctcttgcttttgggcatttaatttgtttccttctcttcagtattatcaacaccccattattaaaacagaaaatctttatcaagcagctttaaaaacatattctcggacaggcacggtggctcacgcctgtaaacctagcactttgggaggccgaggcgggtggatcacgaggtcaggagatggagaccatcctggctaacatggtgaaaccccgtctctactaaaaatacaaaacaaattagccgggcgtggtggcaggtgcctgtagttccagctactcgggaggttgaggcaggagaatggtgtgaacctgggaggtggagcttgcagtgagccaagattgcgccactgcactccagcctgggcgacagagtgagactccgtctcaaaaaaaaaaaaaaagtattctcctaaattctcagtggaatttctgggtcctgtggaatgtatacatatgttgctcctcctaaaaggagtggataaactcctctcctacaagcagtgttctgcactggccctttctacaaattcctttcaccctggtattatcataatctaaaaaataataatttgagaatcaaaaaataacagctatgcttgttttcttcaggaaaacagaacaggttatccatatatctgcagggtttttttctccacaaaagaaaggccagccattttcaataacaagtagtttggcaggaccagaaccattccattgggtcactggtaaaatttgtctttggctttaaacattaaggcagccaggactgtgtctttggacattgatacagcatttagtccagtcttatttacaattaggctttttgataatggcttttgggctgacgttaagtataaaatctgaaattagattttttaaagattataatcaaaaagcaaaaatgtcttcctagaaatagcaaaggaatgcttttgctggatttgctccactaactcatgtaggcaatataccaaactcaaacagccagcagttgttttgtaaaagacaaactgcatctgaaatcagtatgacaggaccacagtttccatctcatcacttccaccaacttacatttaagaaagcacaacttgaataataaaaaccaccatagagtaaacaaattcttcaatgagaatgctttgaagtcaagagaaaaataggctcagggcattgtgttacagcaaaattttgcctttggcaaaagttttacgatggaatagggtttttaaaatattgggaatcaggtaaattgcatggctaattgaactggggaagacagcttaatgagctcatttctctccttcaaatccaagaagtcagaaggcaagttttcatctattctttcatttatccaattagaacatatcgtccccacacatagggctactagaagaagtaatagttatgtctgatggctcttaggaagtattgtcaatagataggacctcctctgtagttataactacagatgatcaaattaaccagaaataaattttggtcataaatttcttcttgctccactctgtaggctacctcctccaaagcagatcgtagaccagtgcatttataaatcacagaatcaccttttaatggttatagactatatatagcatagtgacagtcatatactgctggtgctggtcaaacttgagatcaacaattctgttggatttttacccctctcttccttctttttcctcctcttccatattctgactttcaggtttgagcatgtaataacttccaggatttgttttgggcattatttatatattaccacttatcctaagattattttgagtcagataaaagtaagacattctattaagttatcttcattttgaagatgaagaaactaagattcatagaagtaaagaggactctaggagtaactaactgtccattgtcattgttaatgttacttaacctctttaatcctctgtcgtgaatccaataacgatcaaagtagtaggcaagtttgctgagggccaactgtgtgacaagcactttgataactgattggtctttacagcaaccttatgagagaagtattattactctcatattatgagtgagaaaaataaggattaaagaggtacaggcaattactcaagaacacagggctagcaaatcaagaaacagaagttagatgtgagatattgtatcacccaggcctaaaagatgcaatgaaacaacccattttaaatgtttaatatagtaaccagagtatactctcatttgatgagagtatactcatcaaatgagagtatgcatttgatgttacttttcacagtggcctttttgcagttaggaaacagcagcaccaataatagaactaagctgtctgactcccagcctgtacctaaatctctaacttttgattttatgaaataaatttgatttgcagatgggcattgctggtgagggaaatgtaaagaggtcaatttccccactttaaatttttttggctaaagacccatagctgacaatattttaatggttgccacatattcttcttttatgaagtgagtttcattttatatttgtaagtggtttttattgcaaatcatcacctaacagtcaattctgaagactttccataaatgtcaccttgtttgtgaattgttctcattctgtctcctctctaaattccctcaagaacaactttctttggacattaatatcattattaattgtgaattgtcagctaacagcttagcaattgtctatcatgctcctaatgcatggatgatacagagaatataaagtcaataacttgtatttcctgaaagatacatatacagaagccaatcatttcagtagagtgacaggagcaagattgaggtattaatagagtactctgagagatgagaagcgggacaactaccttagcctaaaggtttgcaaatgattgtggggaaaaataatctttatcactccaaaaagaatattacagtgatattttaattgaccatagagtttaacttgaccattgtaaaatgaccaaaagggtgaattattttttaccaattattaaaaagtagcactacctgatataaacagtgtgacctaatgtttacattcttattattttttctcctttttgtctttttctctctccccagctaagtagaaaaaactcactttgttttcatgctaaaattttggaataccattaaacagcaacacactggacaactacattcttatgttttatcttctccctttaagattgttaaaggaagaaattgaactagtggggaaaagtaaatactggccaaaaaaaaatgcttttgactagtgtatgttccaatgatgattatgaaatatgtcaaactgttctaaaatactaaatatgtgttactatttattctgtattaaaatagaacaatagaataacctttgttgtcccaatatgaaaatagtttttaacaatgttaatataaaacaaagagcaaaggaccattatcttggataaacagagagacattactttacatggtttgactcccctgattcataatttaacatgtaactctggcatatgctgggcacttagggaagtcacattaagtatttcacagcaaatggagagtgagaaaaatgattttcagaaatcctggtatttacttattataaatcttgtcttgaatttattgtactttacatgaaatataatttgataaaatgtaattggtttcagtgtgtatgcaaaatgagaattttctgatcattcagatatcaaaattaactttataaatacaaatacatataattacctattaaaattctaaggtgtatttattttaataaaagtctttatcaaacctagataaatctcatttatgattataaatgtaaaactcctaaatttttttttacttggctttatttactattaatgatgttgggtttattaaaaaatgcaagcacagactccaattagcctactaacctattgtataatttatcaattcaataggtcaaacaattaaatcagaacatttaataaaattgacaatatttttttatttttttacaaaaatccatattggttgttttgaagtagcaatttcttcttcaaaatgataaaaattgtctatgtaaaatcaatagtcaatactataaaagctgcaacattatagacattttcattaaaatgagtaaaaagataattatgcctatcacactactataccatataaattaactattatgctgaaaattctggccaataaagtaggggaaggaaataaatataactgtatatttaaaattatgaactaaatcttcactgttttacaggcaaaggaaaattctaatatctgataaaatctttaaagtcaattaaaaaagagtatactaaagaaaaatgaataattttctcaaaaaggactatatctaaccaagaactaggtgaagattggcattactagtatccaaagacataaatactaaaacagtaattgacatattatctaaaatcaaaatagtgaagatataacaattatgggcagaacacaagaaaatggacattctcagatattgctggtgtgagtatgagtttaatttttctagaaggaatttgaccatatttaacaaaatctttaaaatgtttatactctttgataatgtaatttcatctcataattttcttaaggtaatacttagatatatatccactcccgatccccaaaataaaatggaaaaaaaaaaactaaatgtgtaatgattgcagaagggttgaatgttattttatgagaaatataagaaataatgcagcaaaatacatgatgtttaattatacaaaactatgtagtaatacaaaatatatgatttttaataacacaatacccatgtatattcataattttgaaaagaagaaatatatgcatatacaaatttgaaagaaattatctcatgttgacattttgacttatcatttgctagtcaaattaccagtgcttttaattttctacctcctgcctttgttttataaagaatatttttattatgtctatagttatactaaactcagttcagttgaattgttatttaaatctatggaaaaaattttgctttgtccataaattgtatttatattagaaagttaaaataattaattataaaacatatatccaggtttttttatttgttccagtacataacagacctattacataatttgagtaaattttgtcttacagttatacaggcagttctctccttacacaattctgatatgcatgaatatcagttatcatagtttagttaaatgctaacagtcctccaacaacgtaactcaagtgttgggtaacattgaatattactgtgagtaattacataaacaaacattgctgctggctctgcagtccacaaattaccacataaaataacagatgcacattgtgatcagtgaccgatcacgtttatttttttcagtatctgttggtgattgcgcactacacatttatcattcagtttatttatagaagagaagcgtgtggttgtgttgcctccttgtgagtgataaacccgagtgacactttacaaacacagatattcaaaaaagaagaggaattggacagcaaagaggaaagcactgcaaagaaagaaaatacttgaagtaaaattcagattgaacctaagtggagtcatagaagaaatagtcactactgaggtttgagagattctgaatacgtagccagagctacttagtgaaggtgaacttaacataagtgagggaagtgcttgccacaaatagggtgaagatgtcctggaggaagtgacacccaaacacttcacattagaggaattctcacaggtacttcacaacactaaaagcataaaagttaaaatgttggaagctgattcaaacttagaaaggagcgtgacaattcaccaaggcatagaaaagaagtggccgggtgcggtggctcacgcctgtaatcccagcactttgggcggccgaggtgggcagaacacgaggtcaggagatcgagaccatgctggctaacagggtgaaaccccgtctctactaaaaatacaaaaaattagccaagcgtggtggcgggcgcctgtagtctcagctacttgggaggctgaggcgggagaatcgcttgaacccgtgaggcggagcttgcagtgggcagagatcatgccactgcactccagcctggggaacagagtgagactccatctcaaaaaaaaaaaaaaaaaaaaagatgcttgtgttcagtgtgataagttataggtgagatgaaggcaagcactgttcaaagtacttttagtgagtattttacaaaggactaaaacaacttctccaagtttttaatgttttaaattacagagtactaaataaatggtcatttttactggtttatttctttacatttataaccagcattggagagttgttaacatgttgaagttttacaaagtcttagagctatcataacctttcctgttgattattaagatcactttgcatgtttgtaacacaaaggttaaacacttgaggggatagatgtcgcattttccaagatgtgatgattacacgttgtatctctttttcaaaacatcccatgtagcctataaatacatacacctactacgtacccacaaaaattaaaaattaagaaaaaaaaagatcattttccatggttcaagtttgcatggtcacttttacaattccaccctaccatgcccgtaaatatgctatttctgacttacgaaatatttttcaaataaaatcattgctgacttttaactcactgatatgtgctttacttctggtgaaaggcctaacatatcaataaaatgaaagaaaatcacagctttattttctttactgttctgatattttttgttctagtgtgatcgctgcttgcctctttataatgacaagcctttccgccaaggtgatcaagtttacgctttcaattgtaaaccttgtcaatgcaacagccattccaaaagctgccattacaacatctctgtagacccatttccttttgagcacttcagagggggaggaggagtttgtgatgattgtgagcataacactacaggtaagtagcaaataaattcctgagttggtttggaggcctgtgtgcttctatctacaatgcatattattttaaattatgttattgctatcttatttaaggatgtactttcatacctttaagtttgaaaatcaaagctagttcaccaaatcttcctatttccaaatcactaggtagttttcagaaatagcactctagtcttaaactatatcttttcaggaaaaggattttgttgttgttgttttgttttgttttgttttttaaagagttcacaccatttgactaaaccacaaccatatttagaataactcgggaatgcttactttgaacacatatccttaaagtaagtttccttttgtcccctttattgtcctttatgtctggattctcatgtggagatggcattcattcagatttggcatggacactggtagtctgagaatactctttttgaaaatactaattaaatggagacgatgataatcaaagtcctgttctaaaactacaaagcctttgactagtcattgaaaaataccatccttattttgaaaggcaagaaatggccaacatctgaatttgtgaaatataatagcatatatctgatgggtttcaaagtggtactcttaagcatgaatccatttatcggctgattattgataacttaaatatcacaagatcttgggtaggtgctggggacatgaagatgaataagacaatgaattttctgtctttgggttattgtacagtgggaaagacagactattgaaaggaatgattacaaagttgtctgatgattgctaagatagggcaaggacagtaggagttaaccagttgaaagattaggatggtgaactaaggcttacaattagggaaacattttgtgcagtggcctagaggagggagaaaaatgacacgtttgaaaaaccataagatgggcaaatggctggtggtaagagatattaggaaggaaggcaggacaatatcatagaggactctggagccatgataaagcctttggcttttatctaaggtcaaggagatgacacttaagggttttatatgggaaaggggcataatgagttacttgttattaaaagatacacctggttataaagtaaaaaatggattggagaaggttagagtggttggggaaaactagttagtgaggtgctgcaatagtccaggtgagaaataatgtcagaatacatttcagatggtacggatagagagaaatggatccaagagatatttaggataaaaaagtgagtgttttgtgagcagagtgtaggcaagggaaggaaggagagccaagactgatacctaacattacattctagcttgagcagtaggctcaacattggtgccagccattgagatagaaaatacaggaggattgagatgagggaggagatggcaagttctgttgtggatatgttcactcggtttctaagagacataggagaaactcctgggggcagttggaaacacagttctgaagctctttccttcaaggaaatcctctcatgatgctttagagaagatcagaatcacttacacatgttagtgacaactatgcttatcatggtttataaatgtgtattactcctggtattatttagttcagattcctcttacctcctagactgtaagagagctttgtgaaagagatgcaatgggtattgtgtatttagtttactactgtattacacagcacttagcacagtatttggtacatagtaatcacgcgataaatattcattaattcataaataaaagagagatttctggattggagatatggatttgggagtcaacagcatatgtaaatggaaatagtctagaaatattataaatcaatttaatttttaactagctcaatagccaatatctatcagaatatgagttttcatattattgattattgattatttctgtagtcttcaaatattggagaaatttcaatattttttgagcaaagtacatcatgtttaaagggggaattgatagtcttgagttctacttcagcttatttcaattatcttatacactagtcacgttcactttaaaaattccttgtagtttaggttttttattacataatatagcaaaggaaatttgtaattataaattataaactatgggaattacctgatatatctaatatgtcaggctattctagtatttagtatgaaaagtacttggtatctctaaatataatgaatttctatttcaatctttgaaatgaaaaataatggccactaacataatcatttgtttttaattgtgttaactacagaataataaattatattaagagaagtctcccattttacatgattgagttctagaaaaatatttccaatactacatacctgcttgcttcttactgtataagtatcatctaccacatatgtagaaatttctcctgctgtattgagtttagataaagtgcctggccccagatataaagttttaagtttaggagcaaactctttccaaatgtatgggcccctataaagcacagctttttagaagtgtggtattatataacagatgggagtttaatgaagtaaagcacagtttgtaacaggttcattgtttcatatgctctggatcactaaattggcaggtagagatgaaaggtgcattaaaacggacgttccgaaaattatagaattccctcaaaggaatacagtctttaattttgaattatgcagctgattttaatgaattagaagtcataatgcataacctttccctgatgcaggaaggaactgtgagctgtgcaaggattactttttccgacaagttggtgcagatccttcggccatagatgtttgcaaaccctgtgactgtgatacagttggcactagaaatggtagcattctttgtgatcaggtgagtttttctgagtatttaaggtaaaggattactctgtctgccagaaacttatttggatgttattccactagtagaattgaagactgcatttgccaggaaatcctctatgtgcatttgcatttcaaagagatggttgttcgtgtgcaactttgagtatggacatgaaatatagcactagttcggtggtcctttgcatataaaaaggcttattttagttttaattttacaaatgtcaaaaaatcgaagggtaggggttctaagtaaattggggtatatgtcttggaattattggtgaattaatattaatacatgatataaataaacaagaatagtttctccaaaaattccatagaagatcatatagcaaaagtcacttacacttagggccaaatggaaattatgatagcctcgcttctcaatttcttagtctaactttccctcttaaaagtacaatggattttttataattttaaaactttctgtttacttacatcacaaatatcgatgtctagcctacatgcacacagattctaactaacctcagttcatgtatcctacctcaagcaggaaaacaggcttcttattgaagctgaagtttttcctgttctgataatactaataagtgaaaattgtgaaaatcggtaaaggagaaatttactttgaagaatcaattcaatgattgtattaattttaaacagttatatactctgttatgaataaataaggctaggagcataaaccacaatccagttatagaatatttgttaaaaagttatattgtgaacataatacacacaagacaaaatatctttctcctataattttgagaattcattaaaaattgctttcccaaataaaagacaaatataaaccaagacaaaatatggattcaaagaccttcagagtaaccatcatgtgtcaataagggggcattacatgcttcattagaaagctgaagagtagaaaaattattaataaagacaatttctactatttttattttataatattgagggactattttctcagaaagtcatactacagttttccatatattaattagtaaactctgactgtatctttagattatatttcatttttacacatccaccctgagttttcagcatggctatcttttgcttatcattcaaatattgatatatcatattttgagatatctttgctgaccacccaattacaaaacattctcaagtctttcatatcaccatgttactctcattacaggctctgtaaaattaatttatttgtttacttttcttcttctctctttccaacataaacagaacagtttcgatcatataaaaagcccccaataagtatttgtcacataaatgttgaatgaataaagagagattatctgagcactgatcttatagttagattgttattttaaacggtcattacaataatctgagcattatgtaaattttcacttgcagaacagtttttctccctgaaaatctaaggtcaagagctttgttatatagtataggaagactgtaaactatagttttacctcccagaatctcagttacgtgtctaacctacacgagttacagtgcatcagatttgtctctccatttcaccattcagatctacaagaaattgaaacctgatttttctgaactcaaacttctatttcaagtccgttttatagggatgctagacaaccttgggtggttctgtgcttgtaaataattaacaactgactaagaaaaaaaaaaggccaccataatcaatttcaatctaccagtgagatgtcactgaacatggatttcagaagaaatgtacttaatctgctcttatgagccagtgcagtgtactccagcatactactggctctagatttctttcttaacatcttataaagtggagctaattattggatggaattatgaaagactgtaccatttataagcaggatattagctgtagatagtgttattttttaagttggagaaatttttctctattcctagtttttctgagagtggtttttatgaatggtgttgaattttgtcagctgctatttctgcatcaattattatgatcatgtgatctttttttctttagtttgttagtgaagtagaatacattggttgcctttcaaatgttgaaccagcattgcatccctggaataaaaccacctttgtgtgtgtctttgtgtgtaattcttttcatatattgttaaattttatttgctaaaattttgctaaggattttacatctgtattcataagaaatattgctctatggttttgtttttataaattgtgtttgtttcattttgttattaggataatactctcgtaaaatgaattataaaatcttccttcctgttgtttttctataagaaatgcagaactggtgttaattactctttaaagtttaccccattctaatacatagtattctagtaaatacagtaccccatgtattagtccatttttgtactgctgggaagaaatacccaagacagagtaagttgtaaagaaaaataggtttttatttatttatttatttatttatttagagacagagtctcgctctgtcacccaggctggagtgcagtggctcaatcttggctcactgccacctccacctctggggttcaagctattctcctgcctcggcctcctgaacagctaggattgcagatgctcaccaccatgcctggctaatttttttcttttttttgtatttttagtagagacagagtttcaccatgttggctagactggtgtcaaatcccacccacctcagcctcccaaagtgctaggattacaggcatgagccaccacacctggccagaagaatagatttaatggacttacaattctacgtggctgggaaggcctcacaatcatggctgaaagcaaaggagaagcaaaggcatgtcttacatggcagcaggcaagagagaagtgccgagtgaggaacagggaaagccccttttgaaaccatcagatttcatgagaactaattcactatcattagaacagaatgggggaaactgcccccatgattcaattatctccacctggttcctcccacaacacatggggattatgggaactacaattcaagatgagatttgggttgggacacagccaaactcacacttggcccctcccaaatctcatgttctcaccattcaaaacaaaatcatgcccttccaagagtcccccacagtgttaactcattccagcattaactcaaaagttcaagtccaaagtctcatctgaggcaaggcatgtcccttctgcctacaagcctgtaaaagcaaaagcaagttagttacttcctagatacaatagcggtacaggcaatgggtaactacacacattccaaataggagaaattggccaaagcaaagggcctacagtccccatgcaagtctgaaacccaatggggcagtcattaaacctcaaagttaccaaatgatctcctttgactccatatcttacatccagggcatgctgatgcaagaggtagctcccacagccttgggcagctcggcccctgtggctttgctgggtacagccctccttctggctcctttcacaggctggcattgagtgtctgtggcttttccaggcacacgatgcaaggtgttggtggatctaccattctgaggtctggaggatggtggcccccttctcacagattcaccaggcagtaccccagtggggactctgtgtggggggtctgaccccacatttcccttccacactaccttagcagaggtacttcattcattagggctctgcccctgcagcacatcctctgcctggacatccaggcatttccatacatcctctgaaagctaggcggaagttcccaaacctcaattcttgtcttctgcacacctgcaggcccaacaccatgtggaagctgccaaggcttggagctgccattctctgatgcaatagtctgagctgtatgttgatcccttttagccatagctggagcagttgggacacggcaccaagtccctagactgcacacagtgggggggccctgggcccatgggaccattttttcctcctaggcctccaggcctgtgatgggaggggtgatgagacatgtcctggagacactttcccccattgtcttggtgattaacatttggcttcttgttagttatgcaaatttctgcagccaacttgaatttctctccggaaaatgtgttttgcttttctactgcattgtcagcctgcaaatttttcaaacttttatgctctgcttcctctttaacacttactacttagacatttcttccactagataccctaaatcatctctttcaagttcaaagctctgcagatctccaggggaggggcaaaatgccaccagcctctttgcatagcaagaatgacctttactccagttccccacaagttacttatctccagctgagaccacctcagcctggcctttattgtccatatcactatcagcattttggtcaaagccattcaacaagtctccaggaagttccaaactttcccacatctttctgtcttctgagccctccaatctctttcaaactttcccacattttcctaccttcttctgagccctcccaactgttccagcctctgcctgttacccagtcccaaagttgcttccacttttttgggtgtctttacagcagcgccccactacccagtactgatttattgtattagtccattctcactcaactataagaacaaacctgagactgggtaatttataaaggaaggatgttaattgacttatagttcctcagggcgggggaggcctcagtaaacttacaatcatggcagaaggggaaacaaacacatccttcttcacatggtgacagcaaggagaagtgccaagtgagggtgggggaaagttccttataaaaccatcagatcatgtgagaactcactatcagaagaataggatgggagaaactgcccctcatgattcaattatctccacctggttcctcccatgacatggggattatgggaactacaattcaagatgagatttgggtggggacacagcgaacacatattgctccagtaaaactatctcagatttctttggaaacagaaataatttattattaattcaaaattaaatactacatatatatgtacatatatgtgtgtatatatgtatatatatagagagagaaagacagagagagagatacaaggaaatgagagtcatattaacatcattaggaatttaatattactagaagacagttcagaataaccttaaaatcccaaaagaagacattttgaagaaaaacttgatactcagttctatccaagctatggcaccaacatgaggttaagattctttttgtacgagagatggtcaaaacattaccattcataaccccatattaaaatattcaatatgcaaagtgaaaaaggaatgtaagactggggacaacattaaacaaaggaaatgacaaacaattatgatccaaagaaataaatacataagtcaaaaaatattttcaaagtatccattggtctttatggtctgcaaggatagtttccttacatacatgtttagtaattcaattttatttaagatcaaatcacaattttttgtgatttgagataaacaaataacaagtagagggctaaaaatactatatccaaatatttcagtgagaaactggatgcttttttcctaagatcaaaagcaagataacaatatcccataacattgtactgaaagttgtagccaagaaaatgaaataaaagacattgagactggaaaaagagaagttatttgtatttgcatatgccattatcttatagatagaaaatcctaaggaattaattcaaaagtattaaaactaataaattcaggctgggcgcggtggctcatgcctgtaatcccagcactttgggaagccgaggcgggtggatcacgaggtcagcagatggagaccatcctggctaacatggtgaaaccccatctctattacaaatacaaaaacaaaattagctgggcatggtggtgggtgcctgtagtcccagctactggggaggctgaggtgggagaatggtgtgaacctgggaggtggagcttgcagtgagctgagatcatgccactgcactccagcctgggcgacagaacgagactacatctaacaacaacaacagaaaaaaacctaataaattcagcaaggttgcagagtacaatatcaatacacaaagatcaattatatttccatatatttgcactgaacaatctgaaaataaaattaagaaaacgtcttttaaaaatcaccaaaagattaaaatatttagaaaaacatttagtaaaagaagtgtaaaattatattctgaaaaccataaaacattgctgaaataaagaagaactaaataaatagaatgacacccaatgctcatgtatcagaagacttaatattattaaattaacaacactctccaattgatctacagatttagtgtaatctttgttaaatgcccaccttacttctttgcagacattgaccatatgatcctaaagtttgtatgaaattcatgggactcaaaaatgtccaagataaccttataaaaaaagagttggaaaactcacccttcccaatttcaaaatttactataatcaagacagcatggtactgggataaagatagacatagagacatattcactgaaatagaattgagaatttacaaataagccctcatatttatagtcaattgatttttgacaacagtgccaagacagttcagtggagaaagtgtagtcgttttaacaaatggtcctgggacaattgtgtttttatatgcaaaagaatgaacttggactcctaccccacctcacatataaacaaattaattcaaattaaacaaaatattgaatataaaagctaaaattataaaatcttgagaagaaaatgtagatgcaaatcttcatgtcctcggattagccagtggctttttagatatgacaccaaacgcctaagaaacagaagataaaatgtgtaagttggacttcattagaattaatatttcaaagcacaccaacaagaaagtgaaataaacaacccaaagaattagttgcaaagtatataataaatctgtaataatgaagaaaatatttgcacagcatatatctgataagaagcttgtctagtatatatgaagaacttgaagtgaataatcaaaagacaaataactcaattttaaaatgcgcaaataatctgaatagatatttctctaaggaagatataaaattaccagcaagcacataaaaagatttttgacattagtcatcagggaaatgcaaatcaaaactactgtgcaagcccacttcccaaccagtgggatgactgcaactcaaaaaaaaaaaaaaaaaaaaaacagacaaaaacaaaatttggtgaggatgtggagaaattggagtcttctcataggctgcctgtgagaatgtaaaatgtgcaccgactttggaaaatggcttagtgtttctcaaaatattaaagatggaattaccatataacccagaagtttcactcctctgtatgtatcatatatcctcataaaatcttattggtgaatgtcaatgccacattgtttgtaatagtcagaatgtccatcaactgctgaatgaatagataaaatgtagtataatcacacaatggaatattattttacattaaaaagaaagaaattactggtacctgctacaaaatgtgctcaagtctcagaaattagagtagggaaaggaagacggacgaagaatagagaaagcttgttttgttttgtttccaagtgcaaaaatctgttttaaaaatatatggaaggaaagacatgctttaaaatgttaacttttttggttttaaaaacatttttccttttatataaacttttttctctttccaaatctgctttatttataacttttatagtcagaaaaaaaggagaattttcattcaacctgatatatagccagagagaattacacataagaataggaatgtaaataagaatgatagaactgttttctgactttaaacccccacattgtttatctttaaatcacattcatatattatcttaatttttattattttctcatgctccaagtatagagacaaagtttatggagtatcgttacatgtggagatattgtgtcaagtctaccttacctaaataatgttataaaagatttcaaaaaatgtttccagacattgtcaataggataacagaacacacacttaaaaagttgtcaacagtgtcagaattataaactgcaaaattgaattcaaggacatttaaaaaattcatgcaatttcaatccttaataatattagggagcacacaaggaaattaggcagtagttcaagtctcattttgttataataacttaggaatgaagccagccccaaatggcctgagtgactgtgtcgtgcgctctatgttctggaagggaactttccctttggcacttgtcatttgaaactcaatccaatctcataagatatggcatgtttgccttattcttccataagaaatgttgtaattcttccttatgtgaatgccaaaatcttgagaggggcataaagtaatgctctgagtcactgaatcctaaaaatactgatgccacagtcaagacagagagaacatctaaagcacagtactaatattaataggagagaggaaaatgaagagtaataatgattattgaggaataactaacatggaatccttggatcccttgggttactatatgagtgtatattttatgtctgtataaattgagtaggatacaatttatgtctgtgtcatacaactgtaagtctgtgtatttttccttttttttttcttttgtctgtatttttgagggtgagagctttcagtactttcatcagatccaaaagggatacatgaaccaaaaaagatgataattatttcaccatggaaaagaagtctatcttatgaacaggctgggttattagttcaggtacatattatgtgagtttttcaggataccactgcacttccttcttgtttgcttgaacttaatgcatgaattacttgacatgcatcctgagttggaggttaactgtccttttccatttcctcatctagtgtgacttaagttcagatcaatcaaatagagtcccaggcctagatgatgcctcttctgtactttgacatatctggagaagggtctgtgaatccacacctaaagtgcatacatctagagatctcagtctgatcctgacccaaggtgggagtgagccgcttgtctccatcctttccctccactgaccccactcctccacatattttctggtagccccagagtccctgctatagccacctccacaggtgatggtgataaggtagggagaccggtgaaagtccctaacataagtccctagcatatggcctgactcatgtagaatgcattcaagaaatattgtctgagtgctttcttgcttgggacttttttcatccctgctaccttctctcccgtttactttgcttgttattgggttgagctgaggaagccatgggggttcagccactgtagtcaagatggtggtcatcagctagggtagtcctcaaacttttaatgcacatgtgactatcctaggtatctttttaaaagacagattctcattcaggaagtttggggttggggctcagattttacatgtgtaaaagttcccagatgatacaattgccgcctgtctgtgaaccactttttgataaccaaggagttagaacactgtatatcaaagatatgtagaccaaagaagctgaatgtagatgggggtaggggagttgtgagtgtgtactcacgagcacatgtatactcttggtcagttgtgggtttactttgctccatcctctgaatcccatcttaaaagcaaggattttccaagtcatccaaattaagttaggcttgaattgtgccctgggctctacctttaaaattagagtatatcacctaatagccatttttaaaaggaaataaaaacaacaaataagggaattaaaaagttgtgtgaaaaccaaaaatatagttgtaattatataaaaagagagaatagcagattgtaatgctcaataaagcatcaataggttactgtaatagcaacagaacagaaataaatgattaagagatatttaaaaatagattaataagaaaggaaactgaggttgaaatgaattagacgaaatggaaaggcatcagtgaaagaagcatttctaggtctgacctatggaagatggaataataaggaacagagaccctactcatgaaaattgattgttctggtgaagtgataattttcaaaacaatacatttaaaatttgaacagaatatactttctctgcataatgtaccatttttctgcagttcattaatggtttctcttctgttcagaattaggtatttgtcattaattaccataacatgtccaaaagtcatcaggtgaacttccctgaagtatattcttatattttgtatgactcaaatattaaagtgtacaaatagaaaaaataagtattgcataagtttccttagcttatgagaaacctgaccatgaatagtatgatccatggatattggatgtatacattgaggtggtgaaggatgtgaaaagaggagagttttcccagagcttcaatagagacagaaaggtcttggcacaagccacgtggtctctccttcagagaattagggaagtttagtagtaatatttctcatagagctggtaaattgagtaatatctcattattctgagattgtagaggatgagattcacaaagacaggaacaaaggtcctggggtataaatgggaaaagaagggaaaaattaatcttagctggataggaaggttagtattgagggagttatccaagaatcaaggttgtgacaaactgcctgaaagtaaaaatagatggagttgtaactgagatgaggtcttagcctccagtttatgttgagttccacatgtttgaatacatctgacatctttttgggaacaagctcatcacaagggcccaggtatacaaaattggccaaataccaatacctcaggcatttaaggctagattcaatagccctaaatagccataatagcactagcagaagcattaggtagtgtctggatattggaagaactgatttaactagtaagtgcaagataatgtgatacaaggcccattgccttgctaccaatagcaatgtagttagaataggctaaacagatgtaacaaacccccaaatatctagtggccaaaacaatatacaggctcatttgttgctcatataacctctccaagacagctgttcctacctccttgttggatcttctctttgtgacaattcagggacacatgctccttccattgcctggatatgcctttaactagggaaggaaaagacaatgtggaaaacaacttccacttttaaaatgctttggtccaaaagaggtgtgtgtcgcttctgctatcattgccattgatgatagctagtcacattgctaactagttatatagaaggctgaagacatgtagtctctagctgggtaaccactttgcagctacatttgtgtactattgaagactagggagaatgagtcttgatggggagcatgtcatctctgcttaatactcatgcaacagaaggtagcccaagagcgaaaggggcattctcttcttttctacacacagaacaggataacttctgtttaatgaggacctctgagaatagagtaccccatgagcatctcaggggtgccaagccattaatattggtgggactacctgcttggaggtggaccctgtaatattggtagatgcacctgtgaaagcacatatcatagcagcatgtatcagcaagagagaattggacataggaggagaaacagcttgtgtgcaaggttaaaagatttgttcatgagcacatgtgagagagaagccccaggaacaaggaaatgagaaaacaattactgcctcctacatgttcccagaggagggggctgggagagcaattaagcataaagagcattaattgcatagaagatgctgagggatcatagatttgaaagcaatttcaaaatatgagtattttaagacttttagcaagaacagacaccataggctgtatatagtttcctggagttatgattaaaggatgaaaacaacttttgtttagatatgtaggtaggtaagtaggtagatatagatagatatgagaatagtaagtttgtttaaacaaattattcattacatcatagtgacccttagtgctttttgatgatactgactgatatggtttggctgtgtccctacccaaatctcatctaatagctcccataattcccacgtgttgtgggagcaacctggtgggagatgattgaatcatgggggcaggtctttcctgtgctgttcttgtgataatgaatgagtctcatgagatctgatggttttaaaaatgggagtttacctgcacaagctttctctgcctgctgccatccatgtaagaggtgacttgctcctccttgccttctgccatgattgtgaggcctccccagccatatggaactgtaagtccaacaaacccccttcttttgtaaattgcccagtctcaggtatgtctttatcaccagcgtgaaaacagacgagtacactggcttattgaggaacagaatataatcagcctccttcattcctcactcactaaaccaatgtgctgatcatttctagaggcaaggacactccaagaatcaagaaagagccgatgatgaggctttctattattctcctggactggacgttgtctcagcttctgctgggccatagaaccctgcctctaccttgacttacccacatgttgttttggtgccaagtattgagtgctgcattttggggtgtacaagacagattggcatattgctaaaaatgtgcgaggacagaaatgacagaaactagtctgtaagattctcataggttccacttgtcttgcactcgtcatgtacaaaaatatgccaagcattgtagttcattaattcagtccttaccaaagctggtaaagcagttattaatttatccactgtaaagttgaggacatccagccttttggaaattaaataactcctccaatatcacacaagtaataaggaggttgtgcagaaattgaaaacttgtgaatttccaaagctcatgcccagctggaggttagagacatagggttcctaccaaaaatgtgttcctagcactcagcatagtgttcagcacttaagaggaaacctacagcagattgctaaactgggtatttacttacactatccaaaagtaggaaggaaacatacccatttgtttgtgaattattgtatcaaatcctattaatttcatcctaaatattaaataaaattcctaaataggaaatagcaatgttcatataaagaagcagcaaattaatttattggaatcgacacattcctcaaatggagatttggttgatattagagacttaatgtacctcccttagtgcttaatgtataacagagattccacttatcttacctatataacctaagaaatttgaatattttataaagttactttttagaaaacctgatttatttgttttccttgtcatctcagatggataccttcctctcaaaatctatttggaatttatattttcaagtattcaattaactaacatattaagcaggcattctcctgtgtaagttcctagcaacttttaccacttgtactaaaataaaacagatagttaagccaaatgagttaacttttctgaaagtgtatctttatacaacattaactatagacatggaaaatacatttattcacgttagaaataaatgcttctgtgagatctttcattttgataaagtcaaaacaccatcttattaataactactatattaattttgcagcaaattacaataagaccacactgtatagttgtgccattcagatgacatttatgaaatgctctaatttaacatggtgacatatattacctgcatcttttacacattatagcttatatcctctgagcgaaatagacctaaaccatccaaaaaaaaagagagagagagagagaataatgcaatgggaaattatacccctttgagaactagaaggactataattacattgcttcctcttaaaaccattcaaatatgtaaccattgctgggaacagcagtatgtggggaacctctttacactctttctgtcttgaacactcaaaagattgagaaaaaaatattcctttcctactatagttttatttgagcatgcttcagaattttacctttttgcacactccttagagattatcgtggggaagtttagaaagcagtttcttggaaatgccttttggaggggaagaggagctataaaaatataccagcctgacaaatgacaggcattgtagactggaaaagaaaagacatcttggttttacaccaatgtagaagcttttctttgcaaatgagtatttttgacagctgagcaagatgataaacagaagtatcacaaaacacttaaatggaaacaagtattatgatgtactttattcacctggcattctccaattcatgacatttatatgtggcagaacccactgcagattcatttatttatttttgaagtggaatgagttccttacgaaggtagcctgttacattaatgtggacttttcttctctagatgcagaagcttaaggaaaaaagttattgtatctgtactataaataagtggtaagtctcagaatccacatcttagggctgagaaggctcctagcaagtacaatatactgtataaatatagacaaataaatatagatatagattttttgtgtaagcaccggcagtgttgcaaatgattagatatttcataaatgccttttctaaaaaggtattgctgaaaccagtctatttctagaacttatattcagatgtttagaggtataaatgcttcaatattggctaagcttagaaaggctatgtttctctgaggctcagtgatagacataccaacaatttgatgagatgcatgactaagaagaaaaagagagtaagactgagtccctgtgaattgattgacttggtgcagtggcagagtaggtagcaagtattaaagcaatagttcttaaatgttagtgttcataagaatcatcaacagaactttttaaaaatgaagattcctaggttttaactttagcgacttttaattctttaggtctggtatatttggttgtgggaaatcaaaagactcaacttcggaatacactgaacagttgctgactatagatttgtatattcaaaattttttggtatttaaaaatggtatgtatggtttattgagtcaaatattttaaaaactatgaatgtgtgctggtttgtttttttttttttttctggattggaggacaatttggggtaagcattctctatttaacaagtcataattaactccctgccaaaactaagtagaaattgtgatttctataactcctatatttgataatatctcctaaaaatatttcagtgatatagcatttaattgcaaataattcatctagtcaccaaacaaatgtagggacgttcctatataccaggcactgtgcatatcaaggtgtatattacagtgaataacagaaacactcacgaagtgttcaattgaatttaaccttgaaatgtattatttattattattatgtttaaataaactatgtgaggtttttttttcattgccaatgagaaacccaccctaacttcagaatttttatctttaagtatatcctattttaaccacccttacccatccactctcaatgatttctcctcagtgtggggccttgccgtggaagtgtgccctggtcagtgagttttgagagtccgtggaagctagattgccctcggctcttcagttcccactgcagaactcttgcagtcactggctattggatcagcagaacctcttctattttcagtcgcccattttcaaattggctcactgaactttaggttctccagttttcaggtctttcaaaagtccgacacccctttactatcatctgctttctcctacacaggggctaatgccatgcaggttttgtgactgctggtggtgtgttcctacctgctttttttgggaggcttctgggcacagctggtcacctagtttcattataatcatttttaatggctttgctgttgttgtgttgctgtttagttctgtcagcttttatcctgggatttagagagacccaagagttctgtggccacataaccattgatcctgattcccctggagtctcttttgacttttactgcctaatttaagctgaacatatgaaatacatgaaaaaactgaaagctcaagctcgtttgttgtttgtcttcctaggttatggtttccatttctccctctttctcaacctattttgccaatcaatgtctatccttccttcactttttgcctactcactacaatattcaattacacaaacataatttttcctctgcccaccccagcaccagcatttttctgggagtttaagtctcttatgaatctgggaagaaaggaactaaaaatgagcagggatgaatagcaaaatgagtgagtcaacgagtagcaggcaggacattagagtgaagctgttttcttacccagaagactgatgatgggaaaggaaaaaagaacaattcaaaattagtagaagaaaagaaataattaataaaacatgagtggatattaatcaaatagaaattggacaaaaaatagtgaaaatgaacaaacgcaatagtttgtcctttgaaaaggttaataaagttgatgagcagaaaacacaaagtaccaacatcaaaaacacaaattaccaacatcagaaatttaaaaaagagacatcaatgtcgttgcacattttataaacattaaaaaattacagttttatgaacagctctgctaataaatctgatgtcctgaatgaaatgaacaaatgaacacaaaaccaacaacaaaaaatagaaatagcctcacatatattaaagacatttaattcatatctaaaaacctttcaacaaggaaaatctcagtcccaaatggcttcactaatgaatttgccactaacataaaggaataaataatattagtcctacacaaactctttcagaaaaccaaggaagggcatatatttctcagctcattttgtgagggctacctaactttaatcccataacctaacaaagcactaaaagaaaagcccattagaatattccatatgaacatagatgtaaaataccttaacagcatattagcaaatggaatcctgcaatatataatagggtaatgcatcatagctgattggatttctcccaggaatgcaaagttagtttaacatctgaaaatcagttaatgtagtaagccacataaatagaatacaaaagaattcccaggtaatcatctcaatagatcaaaaaactttgaaaaagaattcaaaacactttcatgataaataccctctgcctactaggaatacaagagaacttcctcaaactgaaaagggcatctgcaaaaaccctatagctaatattatgttaacaataaatgttaaattttttaccactacatcaggaacaaagcaaggaggtttgctcttataacttctactaaaaattgtaacagaagtctaaagtaggacaaaatgaaaaaacaaaaagccatgaatatcaagaaagaagtaagactattattatttgcagaaaatatgccactgtatagacagtgggagtataaaaattgcttggcaagcatcaagtcccccacatacaatcccctcctcacactactctccttcgtaaagccatgaaaaaccgctttatattctaagtaaggacgggatgtttgatgtgcaaatgcagctgtaagataaatccctgagcaacatttttggccaccctgcccttcctatagaaagtctggggctgtcactgaggtagggttagtaatggtatgtgagactggagagatatgtggaaaccacctcatggtatttggtcttcactagttaggcaatagggagctattgaatatttctgagcacaggagtgacacagaggtgtaccaagtaggtaagaggcagtggaaacaatctacctcagtggggaagagtattgtatcacaaaatttgtttagaattgctagtacttggtgataattaaaagcaaaacaattttaactgaatcttattattttaattttacttacagaaagtgcatcctcttttgtgtacccaggtgtttcattctcaccaccttaccgtaggattattatcatcagaattaaagtagatgaggcaaggcacagtggctcatgcctgtaatcctagcactttgggaggctgaggcgagaggactgcttaaggccaagagtttgagtttatggtaagctatgttcgtgccactgcactccagcctaggcagcagagtgagaccctgtctcttaaaaaaaaaaaaaaattggaatgaatgaaaattaattgatagcagtttattaaatggattagggagaggaacagactggtagatatcattcagtatacaatagctggttagtgatggcaattctgaaagaagaagtggtagaaactgggaggtgttgctagtgtagtatgacctttcaaaactcacagagtgcatagcttgtggatgtatagaacaatgtgaaagaataaattctccagaaaggaagaagaggagttagagattttataaaagagaagtctatgatgttctctaggaaagaaaagaattttctgaagaatatatgcattgattaaatgatttccttttgccctcatttatatttattttctgttcaaatgaaacacttaaactaacactcaatttccgggacagatttcctgttcttacattcttcaatttgctttttaaatttttactttgtttagcaatatcaacattgcctcattggcttttagtgagtttcttgagaagatgtaatctatagaacattagttcttctctcccaccagacagatgagtgcatagaaagacatatagttatactgctgctgttttaaaagtgttgcttcaaattacctaaaatatagtgactattagataatcactgataaaaactgtgttcatctaatttattcatcttgaaatcatgcttcatatttcctttaagcacaaaatagttatgttcacacatgcacaataaatcatatatggattacttgatgccttgaattcaccctcatagaattttatctcctaatgtaaagaaaactgactggggtaattattgcaggatcttactcttttctgttgtcagtaaccttcccaccaaactcattgtgacaattgtcacccggttgactgtgcatatccaccattgctccagagcctaggccagcagacttttgctgcatggtccaaaatggtgaggtcctgggtgtgatcacaaggcaatatgcagcaaacattagtgaccatcagtgctaacaaagaaacttacaaagtaacaacttgaccacttggccaattcttccactgtgttttcagctcttcacaggtgtaggccatgccttaaacttaattgagtctagcactcttcctgttactattattatatttgtagcttatgataagcagagtgaatttaacataggggttatgatcatgcatttgagagttgggccacttagtaactgtattagtccgttttcacactgctgataaagacatacctgagactgggtaatttatacaggaaaaatttatacaggacttacagttccacatggctggggaggcctcacgatcatggcagaaggcaaagaggagtaagtcacatcttgtatgggtggcagcaagcaaagagagagcttgtgcaggggaactcttgtttttaaaaccatcagatctcgtgagatttattcactatcatgagaacagcacaagaaagacctgctcccatgattcaattatttcccactgggtctccccccacaacacataggaattcaagatgagatttgggtgaggacacagccaaaccctattggtaactgcaccacctttaataagtaatttgatctttctaaggtttaaattcttcttctgtcaaatgaagattcatgtattttcacaaataataaaatgacgaaaattcctgccactatggagcttacattgtaaagtgatttggggagttggaagagaaagaacaatcaataaatataaaaataagtaagtttatttactaagttaaatgctataggagaaaactagacaaagtaaaatgccttgagagtaccatattaaggaaaggaattgcagttttggaaatgtagccaagagacttttaattgaaaagatggcatttcacttgagacctgaaggagatgaaggagttagtcatgtggaaatctggaagaagagacctaggcagaggcagcagcctatgcaaacaccataaggtggaagcacccctgatgtattcagaaaaggggctgtatagctgaagtgagcagaagaaagagtaggaatgtcccaagcctacgggatccttgtgcaagctgcaaataattggtcctttcactttgcaagtactgccccacatccatcaaatactttagaaggtttgaaaaaagtttgactatcaatcacttgatgaattttcctgcccactatttgctctataccagtgtgaaatgtacagagtaatacttccacttcatctttaccgagcacttactatgttccagagatgatgctaaacatgtttacattaataatctcagttaatcctgacaacagacctatgaggtagatattattatgctcattttattgataaatacgtgaagacttcagtagatttaagttgttcagagtatagttaattctgtggctagtaattgtggcacataatcctaatgttccaggaatttatatcatttagttgaggagacactcctcaactcctgtctcaggtgacaggagtaagtgaaattctaaggcacaatatagcatggtgcataagcaggcaggactgcagccacagaaccctcaattttaattcaggctaagtcacttactttcccttttatgttagagacgtctgttagtttttctacaggaagtataatacctcacagggtaatttattcacaaatacgaaaacatgtataaaacatcatagcagtctgcctgcaatatcgtaagtgttcaaaagggttgtggatattattattgttgttgtaagctaaggaacgctagaaaaacatcaaagattcaattactcaaaataacttttgctgagcatctactacatgtaaaatatgtatactgtgggatcaatggatgatgtaaaggtgcaaaaggttctggcccttggggagtgtatggtacactgggaagttatattttcagacaagacataataattctaatacaagctagaccttaaggaattgaatgacagaggtaacaagaaaatgctgtaaaatggctgaggagagaaaaatcctctaatttgggaggagctcagtattgacaaaggctagaaatgggtagagaacactttcccaaaagagatgtcgtggtgcctggtgagacaggctgtgaacttgacttctcccatccgttccattattaatgtgtgtctctgtgctctagcattcatttcatcttgtggacatgctattgtttccatttaaaaactctcttgatcacaatttcttctgtggcgatggtctcatgtcctgctctcctttttggcaaaactccttaaaagacttgtctaggctcatgcctccaaatcctattctgctattatttcctggaaatatatctgtcaggccttcactctcatcattactttgcaacttttcttgttaaggtctccaaggacctctgtctttttaaacaaagctaaattctgtcttcattgtatttgacatacaagcaggatttgacacagttgatcactctcttttcatttagaggactccacattctccgggttttcctcccatatccctgactatttcttctgtatcctttttctgtgccctcctcttacctttgaacacttattgttggagtgctctggaactctctttagaggactttcctgtatctacgctcacgcccttggtgatattttacttcaaataccaattatacacagacaatactcaaatgaatttcacaatcatatttccaattaaacacttaacatgttttatatatatatataaaatattatttgaatttaattatctttatcttcacatcaatacataataatctatcagcaaatcatgttggttctattttcaaaaatatccatagtctttcattcttcctagattcaataattcctttgcttgtctatttagttttctatatgtcattaatcttcctcatgctgacgtctttgctacatgaatatatacatatatatggtacacatacatatatattttatgcacacacacatacatatttatgctcaaggacctcctgccctgctatcagcctagagcttttcatatacctctacatcctcatttcctgaatcccatgccttccattcttgttgctgttgtctgtttactttctttttgctggaactatattactcaatagcttcctgatataggaagttaaagttttgaatccttgcaaatccagaaaatgtttgtattctttctttacaggcaaccgataatataacttagcatagaattctggattagaaataactttactcataatttggaaggtaccattcttagctttttagtttactataatgttgcagaatactgcagtgatattctgtattttctatgtgacttattttattggtctctggaaatttttgtttcctttttatttttggaatttgaatgcttcatgagattgcaccttgatctgggtttttccaccagcatgtggtgagccttttttttaactttttaatattttatttttaatcaatcaacacataatatttatacctattatgggatacagagagatatttcaatacatatgtaaaatgtgtgagtatcaaatcagtgtaattagcaaatccattaccaccaacctgtatcatttctttgtgttgggaacattcaaaatcctttcttctagctatttgaaaacatataataaattgttgttaactatagtcaccatacagtactataaaacacaggaatttattcttcttacctatctgtgattttgtatctgttaaccagcctctccctatccccttctccctgctatccttccaagactccagtaaccactattcgaccttctactttcatgagatcaactggtttagcttccacatatgagtcagaacaggtaatatttatctttctgtgccaggcttatttcacttaacataatgtcttccgggctaaacataatgccctctaggctaatccatgttgcttcaaaagacagagttttattccttttcatggctgaatagtatttcattatatatttatatatgtgatatatgatatatatatatatatcaaattttctttatctattcctttgctaatgagcacttaggttgattctatatcttagctattgtaaatagtactgcaataaacatgggagtgcagatatctcttcaacgtactgatttcaaaacgtctggatatatgtacccagtagtgggattgctgaatcatatggtagttctctttttagtttttttaagtgaccttcatacttttttccataatggtatgctaatttacattcctaccaacagtgtataagaattcccttttctctgcatccttgtaagcatttgttattttttgtcatttttataacatattttaactgggaaaagataatattgtggcttttgtttgcatttgtctgatgattagcaatgttgagcattttttcgtgtacttgttggctatttgtatgtcttcttttgagaaatgtctgtccagaccatttgcacctgttttaattggattatttggggccattgagttgattttcttatatattctaggtattaaacatttcttggatgaataccttgcaagtatttttccattctgtaggtcgtctctccactttgttggtagtttcttttgctgcgaaagggcattttagtttgatgtaattccatttgcccagaccaatgtcctgaagcacgtctcctaggtttacttctagtattttcatagttttgggtcttacgttgaagagtttagtccattttgagtggatttttgtatatggtgagagacgggggtctattttcattcatttgcacatggatagccagtttccccagcaccatttattgaagaggatgtccttttcccactctttgtttttggtgactttgttgaaaacccgttggcagtaaataggtggatttatttctgggttctctattctgttccattggtttctgtgtctgttttacgacagtatcatgctgtatagctttgtagtaaattttgcagttaagtagtatgatatcctcagtcttgctctttttgaacaggtgactttgtctcaagattgatttgtctagctcagtggggtggctcacgcctgtaatcccagcactttgggaggctgagttggacagatcacttgaagtcaggagttcgagaccagcctgaccaacatggcgaaagactgtctctactaaaaattcaaaaattagcagagcatggtggcgggcacctgtaatctcagctactcaggaggctgaggcaggagaactacttgaacccaggaggtggaggttgcagtgagccaagactgtgccattgcactccagcctgggtgacagagagagaccccacctcaaaaaaaaaaaaattgctttgtctattctgggtctttatggttccatgggaatttaaagaattttttcttctatttctgtgaagaatatcattagtattttgataggaatcatattgaatctgtagattgcttttgataatacagtcatttttataatattagttcctctaatccatgatcatgggatgcctttccattttcttatgtgtcctctttaatttctattataagttttatagttttccttgtacagaacttttaccctttggttacatttattcctcagtatttttgtttttttagctatcgtaagtgagatttcatttttacctagtttgtgcttgttgtataggaatgctactaatttttatatattgatttgatatcctgcaactttattcgtttagtttatcacttctaagagttttttggtggagtgcttagtttttattacatataagatcctgtcatctgtaaaccagaactagttgacttcctcctctccaatttgtattcctgttatttctgtctcttgcctaattgctctggctaggaatttctagttctaggttgaataaagagtagtgaaagtgggcatcaccatcatgttccagttcctagaagaaaagttttcaccttttctccgtttaataagatgttggttgtaggtttgtcatatatggcctttattattgaggtacatttcttccatactaatttgctgacagtttttagcataaagggatgttgaatttcatcaaatgctgtttctgtcttttgagatggtcatatggtttgtccttcattctgttgatatacttttatttatcccatttattcaatttgctcatattgaatcattcctacatccttggtataaatcacacttgatcctggtatgtaatatttttgatgtgctgttggattcggtctgccagtattttattgatgatctttgcaactatggtcatcaggaatattggcctgtagtttttgctgttgcatatttggttttgctatcagggtaatgctggccttataaaattagtttagaagaatttcctctccttcaattttttggaatagtttaagaaaaaatggtattagttcttctattaaagtttggtagatttcagcagtgaagccattgatcctggacttttctttgttgggagactcttaattactgaatcaatctcattacttgtgagtgttctgttcagtgttctattcctccttggttcaattttggccagttgtatgtatccacaaatttatccatttcttctaggtttttcaatttgttggcatatagttattcataatagtctccaatgatcaactgtatttttgtggtttcagttgtagtgtctcctttttcatttctgattttatttgagtcttttttctttttttctcagtctagctaatggtttgtcaatattatctttcaaaatatcaactttttgttttgttgagcttttgtattgtttttggtctcaattttatatccttcttctctgatcttttttatttctatattgtgccttgcagaggacctttctagttaaatacatttgggaacttttgagcttcctggatctgggtatctatgtctgtcccaagacttaggaagttttaagttagtatttcattaataagtttttattaccctttttgtcatcttgtctttctaagctcccacagtatgaatagctgtttgcttaatggtgtcccacaagtcctgtaggctttctttattctttcttattctgttttctttttctttctgtctgcttgagttatttcaatagacctgtctttgagttcataaatcatttttttctgcttgatctagcctgttgtcaaaactcttgattgtatttttatttcattaactaaattgctcagctccaatatttctgtttggttcatttttatgataccaatttcttgttgaatttctgatttagatcatgaattcttttcctgatttttttcagttgcatatctgtattttcttctatcttgctgagtttccttaacatcattattttgaactccttttctggcattttgaaaatctcttttactttggggtctgttactagaggattattgtgttcctttggtagtgtcatgttttcttgctttttcatgtttcttgtgttcctacattgatacctgcacatctggtaaagtaattgcttcttttaatgttatggactagcgcttatagggaaagatttactcctgtagataagttctagagtgttaagtagagggtgataacttgggtcctgagtgggcacagtagtgtagtctctgtgaagtttcttcaactgtaatccatgtcagtaatgtttgtgaatgcttcactgacctaacctgtgggagtttgtggcagcagtgacatgactttactggaatcaggcttattgagtgagttatcaggatggaggcatgtttgtgcatgtgatgggtcacctagcttaggaactggcttgctttgggtgaagccgtgggctgtttctcaggccgggggcatgagtgttcagtggatcagctggttctggaactggttcaccaggagtgaggctgttgggtcgtttctcagtttaggggcataggcacatgttggtttgccagccattaagccttttaaaactatggtttcatgtctggaaaatgtgtattttatactaattctttattaacttattcctttaattttttttccttttggtgtatttctgaaaatttgttttcatctcattattattgttagcctttctgatgtattttcttatctttctcttctaatcttttagttgagatttttttccagcctttttttttttttttggatatagaatcttagtatattgtctaggctggactcaaactcctgggctctaacaatacttctacctaagcctcctgagtagctgggactacaagcacatgccactatgcctggctgtatatttttaatatttaagaattctttctttcaccaattgtttattcttttaggcttttttttgtttctatattttttaatgaatgcaacttttatcttctggggataacagagatattttattaaattgttattagttgatgatttcttccatctctaattccctgcattgtttgtttcctcatctggattatcatttttcatcctcctcctttatttttgtttctgtcattcacattgtatattttgcacatttgatgaattttgccatctgctttattctgtagagaaatggtaaaacatttccaaaatggcctttactcatgtttatgagcagcaatacagctttactttgcagaggttaaaagctcaaatattagttctagagttcttatctttgtagtatttttctgccagtttcctctttatggaaaataactctggctcccggctttctttaaactgtgtagaaggggagttgtggtggtaaaggggagaggcagtgtatacagactttcacttaatcctttcatgtctaccttgtgcctcttccaataacaagttgttgatgttccaatataatggagctggttaatttcaattattcttgacaataagactgatgtcactgtggagtaggattagtttggctggctgagtggggttgaaaaggggacctgaaaatctaaatactttctatgtggaatacctctaattcatgattctcaaccttggcactatggctattctgggctgggtaatttgttgtgagggatggatatgtgcattgcaggatgtttagcagaatccctggctacatatcagtatactacatgccagtagaactcctcccctcactgggacaaccagaaagttcctctggggacaaaatcttccttagctgagaaccattgtttaactttagacctgtgtgtgtcctcttacttctctcaatgtttcattatcttcaagtcttaaggctctcaaagattctataggaaaaatcagttttcatgttttaggaatccaattcagctagcactcaagctgtaacttctctgattattcaagaatgttgtcaatatttatttctatttcttaatttcattttctgtcttcaaaatttttgtaaaatgtatttcttccctattgatttctctgctggcctcattaaaattatgggttatattttttaaaattcctatttttttaattgaagtatcaagaaaaagaggaaaaggcacatgcttgatctgaactttatcaaaaattggtaattgttttcatctcttactattaactcttttttaaatcgatcctcttgctttaggaatccaaatcagcctgcactcgtactgcagtttctctgattagtcaagaacgttgccaatatttatttatatttcttcatttcatttttcgtctttgaaatttttgaaaaatatatttctccattattgttttctctgctggtctcattaaaattatgggttttacttgttaaaattgctgttattttaaagtagtgagaaaaagaggaaaatacatgtgcttaatctaaattttaccaaaaattttatattttagtaaatgtattcagatgcatatttttctgacaatgggcagtcttagttaacacctgtatcctttttcttgagcaagaaaataaatttattataatttttacttattctgccctagtattcctcatggataaatcgtgtcttaattttattaatctttgaatgcatcaattctaataagttggatcctttgtcagaaagcagaatgtgtacaatatacttatcccttagttttgtcttcctgggaactggctcttgatcacaataggatatatacctacagatcagcttcattataatttaatttactgtatttggcagcaacatcttctagtggtaacctagaccgagatgaaatattccatttcaattgacagttataaagctacagaccatagatttcagttatttgagtagttactacattaaaacacatctttttttcccttcctttgctcccaaccacatgtgcagcaaccagtatgtttctaaattttgctcctgtttataatgctatttcttaagcttctaaacatcgcagtgtgcatttcacctctgctaatctccatccaaattctgctatgttttggagtttgtaagaaagtgtagtgctgatgaggggattgaagtttcaggattccaattttggctgcttaacaggaacagttgaaggatggcatgaggtttttgatccatggttttccatttccctggtatagtaagcataggtatcactgccaaacttctttggagctctatgttatttgggttgagagcttggagctatgttaaacagctgaataaatgtttcccaatgcagctctgtctatgatgcagctcctgaaaattctctctgaatgttgtcaactagttttctcttaaattgagtttatagttgttttgtcaggtccaaatgtctttttgagactttactttgactgaacattgtgatagaatttatcctcctgcttgaaatgataaaaatatggacaaaatgtattaaataattgtttgctagatgttggacatcaggcaatgaggacaatgtttgctgagaaataggaaataaattatgtgaatcttacaattgacccggattactgcttacagagtatttctagaccacgacttagggagagaaatcccagatggagctcagagagttctccaaattgaagagatatagccaagtgtttcaggaattcaaagtagttagagtttgcagagagcagatagaggaacacagagataatttcacagatctacagagcatcttccttaagaattcactttactacggttcactgcatgtatgaggctgcagaaagcacaactttcaattattaaaagtaacaataattaacactcatgtaatgctgggtatgtgcctatttccactagctgaactggcgagaaaatttatgattcgtgggatatttgataagagtacacaaaagggtctagcctcaacagtggagaatagccctaggctgataactacttcaataccacctaataaatcttaagagcaagactcaaaaggaactgtttccaagtaatttaactgcatccaagaacaaaacacaaatatatttgtaagaacactgaaatatgtagtacctaacaagaaaaaattcacagtctctggcaccaaatcaaagattatcaggcatgtaaagaagcaggaaagtacaacttataatgaggatgtaaatgcatcaatcaaaattgatccagaattgtgagaaatgttagaattatcaggccagtatgttgaaacagatattacaactctacatagtttaaaagctacataaaaatatggaaggtactaaataaccccacagatcaaaattccagagaaaaacctacactgtatggaatgaaaatacactggatataattgattatacattaaacataaaacatttatgttatatataaaaaattagtgaacttgaagtcatagcaatataacctatccaaaatgaaacagagttgaaagagcatttgtaaaaatgaaaacagcatttgtgagctgtgggacaacttttagaggcttggtatatgtgtaattggagtccctaaaggaatggtggggtggaggtgggaatataaaaaatattcaaataatttatggctgaaaaattccaagtacagtacactgaaaaccataaagccacaaacccatgaatctcaagaaaactaaaaaataagtaacatgaaggaaatcacaaaaggcatattataattgaattgctcaaagctagtgataaatttttaatgataaaataaaatactacagcagccagaggaaaaagacgtgttaaatacaaaggcaaaacagtaagaatgacaacagatttcctatccaaaataatgcaaagaagaagacagtggggcaacattcttataactatgaaagaaaataaatagtgcacttatgattctatatctagtaaagatatctaagatgaaggtgaaataaaaactatttgcaatacatataatgaaagagttcatcacacagaaacctatactataagacacattaaaaagaagtccttcagtaggaaataaaatggtatcatatggaaatatggatctgcacaaagaaacaaagagcacccaaaatggcaactgcattggtaaatacggagggtatttttctaatgatttaattttctttaaatatagttgacagtttaaaaaataataataatatagtaaaagttttataacatgtgtaagtaaaatgtttggcagtaataacacaataattaagagggggaaaaggaagtacccttgacccttgaacgacatgggagttaggggcactgattccctgcacagtcaaaaattcaagtttaattttgactctccaaaagcttaactactaatggcctaccattgaccaaaaaccttactgataacatgaacagtcaattaacatttattttgtatatattatttactgtattcttaccataaagtaatctagagaaaagagaatctttaggacaatcataagaaagagaaaatgtatttactatttgttaagtgaaagtggatcataaagatctttgtcctctttatcttcactttgagtaagatgaggaggaggaataagaggaagaggagagattggtcttgtggcctcatggctggcagaggtggaagaagattcttttataagtagactcatgcagtgataacccatgttgttcaagggacaattgtataccgttgtaagatccttatactctatttgaagtagtctgtcacttaaagctaggctgtgataaagatgtaggataaaaaccactaaaatcataaaacaaagagttataactaataaaccaacatggagataatttgaatcataaagaaatataaaataacacaaaacaggcaaaaaaaaaaaaaaggaaaaaagaaatcccaagcagatgggacaaataggaaatatcaagataatagatttaaacataatcatatcaataataatgctaaatttacatattctaaatactccacttaaaatatacagattggaagattggttaaaaaaggaaaaagtacaacttaactatatgctgcttacagaaaagatatttaagtataagacacaactaggttaaaagtaaatgttggaaaagataaatcttgtgaacactaatcataagaaatctagggtgactttattaatatgagaaaacatgaatttttagaaattttgtccaagataaaatattgcccaggatgaagaaagtaatttcattttgcaaaaggagtcattttgtcaataggacataacaattcttaatatttctgtaccaacagcagagcttcaaaatgcacagagcaaaaactaacgtaactgaaggagaaagtaaaatccacatttgtcggcaaaaatttcaatacccttctctcaataattaatagaacaaactgacaggaaataagtaaatctatagattagaacaacactgtcaaccaacttgacccaatggccagttatggaacattcaacccaacagagcagcaaactacacctacttttcaggcctacacaaaacatctaccaaaataaatcaaattctgaaccataacacaagcctcaatagatttaaaagaattcaaatcatataaagtacattatggggctgcagttaaattaaattagaaatcaataacaaaataacctggaattactctaaatatttggaaactaactaacaaaattctaaataatccaagattagaagaggaaacccaaagaggaattaagaagtattttgaactgaatgaaaatgaaaacacagcataacaaaattgtgagatacccaatatggcaggacttagtagtatattaatagcactaaatgcctatgctaggaaaggatgaagatttcaaagaaatatcttctactttacaaaactagcaaaagaagggaagacccaagccaggctaatgaaagctatttctgagtttctaactgcatctcatggggatgatcatttcttttctctgctcttgtggctgaaagcatgttaaggccaaaattgtgattcaggcaagacccaaatttataagaccaagattgcattttaagccataaagagcaggagaatctccatggcttgaactgtgaatagatatttgtttgttatcagagatagtaattgtactgctttatctgtatttccttccatgttagtaaaagaaagctcagaagtagttgatcacatgatcatagagaataaactacatttctcagtctccttggcagctaggtgtagaaatgtggtttaagttctggtcaatgatattttatctattaacgtttgctgtttaagttagtggctaaaaacaataaaaattgcgtatttatttaggattctatggtttggctcagtgctggtgtgcactggcttgtccaacctcttctgggctctctcatttgtctgtgattagctagctggtcaagcagcagttagataggaagacctcactctcatatgtggtggttggcaagctggctgttcactgggacagtaggagcaattattagctggggcacctcagttctctgccatccaacctctaatattccagcaggatagcatgagcttgctcacaaggtgatctcagagttccaagcccagcaagaaagaatgaactctaaatttgcaggcattttaaattgtctgtttgaatcatatttgcaagcattatatgtgctagtatttggccgaagaaaaccaataggtcaatctagagttattgtggaaggatcgtaccaaagagtgtcttagtgtatttttaaaggaaaggggaatgcctttctctctttctacttcttggtggacagcaattggttttagagtatgagtagatttgtattttctcacattaaaaaggtagaatctacaactgtggaatctatagaagtaaactgggtattttcagttgaatcttgggaaactgactaaagttaacatttttaaaaataataatgctttattttatttttaaactacattttaagatatagttaatatacagaaattataatctatatgtgttacagagagattaatgaaatgggagtaaacttgttattttattaatttgtggcagagttcatatagaaagaattgtttttattgacaaaaatatctcgataagacttaggttttggcaagaatcaaggcaatattatacacttttgagatgtctgtgaaaaagtgaccatgtaaagtcaggtgtatagaaaaaagtgaatatgctttatagcagagcaaggaggaagaagagagaagccacagaagatggtagataattggagtgcaagatggtaggtaattggagtgccaatgaaaatctctagctatagggaaactaaagggatattatgaattgcaaagtaatgatttaattcctcttttaccccgaatctttaataaggtttaacgactacaatttgtttgtttgttttgaacaagacttcttgaaattgaggcattagctgagtttcacctctgggtgacatagggcagtgctggcagaagccagaaagacttcaaaatggaagaagcagaagtgtagggtcagggcgactacgaaatgatcaatacgcatagaattcttataaacttaaggaggacttctgtcattcagggatggaattagggtcataggctgccttatctagatttcaaaaggcaaggacgctccagatgatacatgcattacatgtaaataagaatacaacaaggccaggtgcagtggctcaggtctgtaatcccagcaatttgggaggccgaggcggacagatcacctgaggtcaggagttcaggaccagcctgaccaacatggtgaaactgtgtctctactaaaaagataaaaaattagccgtgcctggtggcccagctactggggaggctgaaacaagagagtcacttgaacctgggaggcggaggttgcagtgagccgagatcgcaccattgtactccaaatttgcaggcatttttaaatgtctgtttcaatcatttttcaagagttaaactccatctcaaaaaaaaaaaaaagaaaaaataacaaaacatataaaagataaaggttttgcacttttatttctctttaccttttgcacacttccttgctctttgaaaaagtattgtttacatgtaatgtttaagattattctttgacggaaacatcacatatgtccaatgccttaaggtgtttactatctctttggagaacaggactgatcctgtaaagtaccagcaaagactcaggcctgagttatgggttgatgtacttgaagtgttacaagtatgtacccacacgcctattggattttcatggtatgcctatatgttacacatatccaccaataaatgccatctatttttgtaggctgaatcaaatctctgtcttgagtaatgattttgtatcctttggactagatctgaataagactgagaaacagccaggcacaagaaggcaattcattgttctcactcatctttctaaacctatatgcatctttgatattgaggttcattattagctacaactacatttggtttgcatataaccatttatttttcagtcttagatattttcatatcaattgtcttaattatccttaaataaagcttccagtgagtctctatttcttggatgaggacaattgaggcagtgatagttctttaaaaattatttaatttctaagtccttcactatatcttgtaactgaatcccaacctagatatttttaaatatccttgaaattaaatataaatcaaataatatctttccacatgtaggttacttccctctatggtaactctgcctccaaatgtgaagagctggattcaatccaagtgaaagaaaatcagtggggaaaatgtcagggactataaaagagatttgaagtctgtacccacattgctgtgttagagtcctgagttattaaatttctcatatttatttgacattttatatacatatgtccacttatgaagagtttagttcttatctttctttaatcaacacagtattaactatgcatgtagtagatgaacactgtattttatgtatttgcattcttttcaaaccagatgcttaaagaataaaatgacacagtgttttagctgttattttgctttaaaatgctttaaaacaagaaacatttttggaatttcttatcacaatataaatcagctaagtatatttaatgtggtgaaatgaatcataaataggctgaaatagtcctaaaaggggagttgggtaagaaaaaaatgtattaggatcaatatcaataggcataaataattctattaacaaataacattaaacattgttacactgtttatgggatgatatcattatatcattatagaaagattctcccttaatttaaatacctagcatgtacaaaacaagtttaaatcaatgagacagtaaacaagaggaataaaatagagaggtgggctgggtgcagtgattcacgcctgtaatcccagcactttgggaggccgaggcgggcggatcacgaggtcaagagatcaagaccaatatggtgaaacctcgcctctgctaaaattacaaaaattagctgagcgtggtggcgggcgcctgtagtcccagctactcggaaggctgaggcaggagaatggtgtgaacccagaaggcggagcttgcagtgagccgagattgagccactgcactccagcctgggtgacagagcgagactccatctcaaaaaaaaaaaaaaaaaaaaaaaaaaggggaagtggtgtcctaaagactaaattaactgctgactattttctattttcagtctctacatatttatatttttatttctttatatagcattgaatggttaattccccatttcccttttattcttatacgactaacttctatgggttttattttcattcagttctgtatattccccctgctgaagcctcccatgttgtgtgtcaagaggaaaaatatcttattaccttcttgtctgttgaacatttagttttcttctccctccctccctgtcttgtacctaatgagcaaattatctaaaaatagatacgttcatcattctacaaaatgttgtatcttctctagattggaggacagtgtaattgtaagagacacgtgtctggcaggcagtgcaatcagtgccagaatggattctacaatctacaagagttggatcctgatggctgcagtccctgtaactgcaatacctctgggacagtggatggagatattacctgtcaccaaaattcaggccagtgcaagtgcaaagcaaacgttattggtacgtgtaacgcaaaagtttacagtcacatctctattaccatctggaataaaattctctatttgatttcttaactgaagagtaaagcaaatttctttgctcaagacaggctggaaaaaaaaacaatttggatgaaattaactgtttaaaatgattaaattaataattctatcaaactgcagcttgaagcttagtttaatcaaccctttagaagtttctttattctgtagatgcattaattcccatggtcccatactaataagtcatagaaaaatataatttgcttactgcatagatgtttcttttagaaaattagcactttttcaaaatgttttacacttaatgagttctaagcaaatcatttccatgctagttttcttaatagaccaaaataagtggattttttcaaaatattctgtgctacagggtcctttgtgataaatctttccatttttttctgttatatttctttgaactgttcctatgaaatgcaaaataagtcaacataattctacagatcatgtatattgctagggttacttacaaagggctacataattttaattttgtaattcagcaccaagttgattataataaacagctgccttcggtgttatttatcatttttttatacaagacgtgcttttttgtttgttactcccacaggtatttttcggaaattagatttgattatagcaatttattacatccaacatttttgaggggaaccaccgccacataaggacaaaatttatcaagtgcctaaaatgcactatgttcataatgcactttgaaattttgatatatgagaatattatgagaggaaagtttcctgatgaagtgagccctgtattgtaactgaatatgtcttggttcctataggaagtttaaaaaagacctttgcctttctattgtcattcaagacaccaagtcatccatggtttttctaacactgacctgaaccttacaatagtaaaaatatgcctggcagtgattacacacactcctctctctctctctctctcacacacacacacgaatgcttacatgtacacatgcatatgtacatatcattctgaatactattttcatttctgtgatatacctctaaatctaattctttatcttttatttatgtaagtgtacatcatgctacacaattcagctagacaagcgtttcaatttaataaagagaatgtaggtgtgtttagtggcattacacgagatttctctggtttaaagaaacattacatgaaaatctgtaccataatttacctatatgcatctcaagcatacagaaactaattttttagaaagaaagaataacgtgtaaagagaagtacatatttgtatgtgctatccatgatgctgaaggaattctaagaccctgaattcaatttgtatggcatcctttgttctttaatgtgagatatattttaaactcaagatgtgaaaacaaaagttaaagcaagacctttaaagacagtgaaataattacttctttgtatcaatggaatctttcttgtgatggttagattccagagcttgaggaagggaaaaatcaaaattaatttagaatgtataatgccatccctactatttgcctgttttgttgattgatccagatggttttctgcaggaaacataaatatatattttgtgaagactaaattacttcagtattataaataattattatttctagtgttatttctgcaaatgtagtactttttataaaaacaaaaacttgatatgcatatatatttactttcctaatgggatcagcaagtaactttattcaatttcaccttgttaatatgaaaaaaaaagaagcccagaaaatacaagtgtatgttgtatacgcttcagaaagcaaactgttagagttaacaaaactgttaaatcttactaatgattctatcaccagtaaaatacattagcaccaataattttattaaagtaggtcattcatctagaataaaaagggagaagaatgtgaattaaatgccaagtgtgctaactcgcctgtacttgttaacaccgaatgtgatgccctgtaggccttcctgactatcgttaggaatagattacctgtcaggaatatgtatggcatattcaaataagcactgtgcatatttttaaaactgatatgatatgaatccatgtagaccaattttaatagttcaaaatgagtcataattcttgttaacaatacagttatttttaaaatttgcagcaatagtggtccttttttattttccttattgaaattaaatgatatgccttaggtgagtcattcatcactgttaaagaacttgccttcattggagttcttgaatttttatccatatatatacatatatattatgtatttccttccagtttaggaaatgcttttctacatatgagttcctgagtatgtttttgactcttattttaagattaatttttaaattgcaattatagcttgaaataaatgtttcagttgattcaacccatgcagtgagttatttaaattcatggatatttggaaactatctaaaggaagtattttgcatctaaacatttactattctaatttttttatttctttgccttgtaatacccttttatcttttagaataaccttacttgtcagagatttaagtttaggtgataaaacatttttcttcattcgtaaaatgtatatgtgtactcctttaaatagaagtaatataaaaaacagaatttacttagtgtttaaagaggtatgttctgagtcacacaagatgacaagcaatgtgattgctttatgagccaaggagagcatgatttatattaattgaaaatgataaaatagaggagcatacaaaaggattaaaccaaaaattgccctggataagttttatttatattaattacttaaatgtgtggattcagaaataagtgtatatgctgttttcacaaaaatagttatcagctgacatttttttcttttttcccagcttcacgaaggtataattaaataaaaattgtatatatttatggcagacaacatgatgttttgatatatgtacacattataaaatgattaattccagctaattaatgtatccatcacctcatgtacttatcatgtttttggggtgagaacatttaagatctaatctcttagcaattttcaagtatacaatacattattattaagtatagtcaccatgctgtacaatagagctccagaacttattcattctgtctagctgaaactttgtactcagcttaaccttttattaaacatctttagagatttcttatctttagaaaaacaactaatttgttatatgtaattctactataattttaaatgagcacatttgttaaaatagtttttaagatttgttaaagagaaaaagagctccagcatatgtaacagaaacaacatttgcattaagcatttttctttgcattaagtaataattaaaaatttatgaagttcatcgcaaacagttgtatattaaagctaaattaaatattgtcattgaattttgagagtaagattggccccctatggcattgcttgtgagaaaacactcaatattttgtgttcgtatcatctgcagtagcattgtttgtgtctcgtctatcttgaatgaaatcattttcccatcctcaccttttaaatatattttatctttagggcttaggtgtgatcattgcaattttggatttaaatttctccgaagctttaatgatgttggatgtgagccctgccagtgtaacctccatggctcagtgaacaaattctgcaatcctcactctgggcagtgtgagtgcaaaaaagaagccaaaggacttcagtgtgacacctgcagagaaaacttttatgggttagatgtcaccaattgtaaggcctgtgactgtgacacagctggatccctccctgggactgtctgtaatgctaagacagggcagtgcatctgcaagcccaatgttgaagggagacagtgcaataaatgtttggagggaaacttctacctacggcaaaataattctttcctctgtctgccttgcaactgtgataagactgggacaataaatggctctctgctgtgtaacaaatcaacaggacaatgtccttgcaaattaggggtaacaggtcttcgctgtaatcagtgtgagcctcacaggtacaatttgaccattgacaattttcaacactgccagatgtgtgagtgtgattccttggggacattacctgggaccatttgtgacccaatcagtggccagtgcctgtgtgtgcctaatcgtcaaggaagaaggtgtaatcagtgtcaaccaggtaagaaagaaatgtattacattttcagtgcacaatgacattccttttgttaacttaggtaacttctccctgtttctggtttgtggcttctacaaattttatttccaaaatcattactgtatttatatcattatccaacacatatataactatttaacttattcaaaattatctgcatatttatgttactattttgagaggatactttagataaaactcagccgatcggatttatttcataattgagactcaatttctacacttgaagtaaatctcctttttaacagttttttaaaaatcagatcaacaagagtcaattttattttccagagaaaggaaaatttgagttgaatatccatacaatgccaaatattcaaatgatgaactaaatctctgaataaagctggctaaatgtttttgctgaagaggctatatgttctagttttatatagaaatacctagaattgtttccacatgccatcaaattaataaaataggccactgtttaatctcattatatacaaacttatctttccatctctttcccaattgggagagggatagaccccatctatggctctccttacatttaagattttaactaaaatactataccttctttacaataaattcattatgatatgatgataaatataagtacttatccgttgtttaacagctgtgctaattgttgtcctgtcagccaatattagctctgagttatatgggtctataaaaatgagcatgataccaactcaaaagtgtgatttgcttgccagagaaggagtagaacaaaagttctgttaacatagcaaagaatccagcctaggataattgggccatgcttttcctttggcattggtcagtgtgtaagatcaaagagacaagaaggaattgatgaagagttcattctttttgtgatgtaagtattaaaaaacaacttgaactggtttaaacataaatggagactatattataactagatactccataaaaacctaaggagaaggaccactgcagtcaggactcaggaattagaatgcttccactgatacatattcatttgtctctctctctctctctctctctctctctctctctctctctctctctcagaaggggactttacctctctctttctctacatgggtatatggccaccctatgtcccctgaaattgtttataattctaccaccagccacaacagagcgatttattagctacctcttagttataatttctagaggaaaattcgaattgactcagttttgtttggttggttacctctgagccaattcattgtggccaggggtgtcacgtacttataaaatgagtatagcttttagggaccatttcatcaggtagaagcaaggtggtaagtatcccagaagacaggaagattatggagacctgggcagacagcctaaatgacagatacagcacattcactctttttaccttcaggttaatcctttcaaatttgcaatcaattaactttttgatatcctaagatgagatgtttttttctcttttagtgtttatcaatatctctaattttggcaacaaagtcctttgtctcctacacagtcaaataaccatgatttatacatccttctttctaagtaaaccaaaacaagctaatagatcaaatgttatatccttttgagtaattatcaattgttaaaatttactgttccagtctaactttaattgtatgtataatacaagtcacatgttttaaacaatttttctgattttggaaaaactctgaaatcatagttacaaacatttgttccctttggtccttccaatgaaagacccaatccatcatctcaatactttgtacacctaccagatatctaaatgatgaactaaaattgttagaaaacctttgtttttctggttgttttgcatatcattgcagaaaaagccatggataatttaatctacaccatgcataagactgtctcatttgttcccttcctaggatgaagaaatactgacttcattgctctttcctttatctttgtggctctcattgtggtgatctctttgttcccaactctaagcccttttctcccacccaaatctatggctctttcctgtctaccctatatagtattggcagaataattcccctaaagcacttaattcgttatgtcattctcctgtagggttaccaaaaatgggttttattttgcttatcatttgagtccaatctgggcaaacctttatgagtttttatcttccagtcgcagtctagacacctagctttgcttcctgatattccctttctcccatcttcttcagtcactgcagccacttcactggagctacacatgtcacatgcagagccgatttcaatctacctgatgctttggttcattctcctttcccgacatggaatgcagtataatcctccttttcaatgttagttggcatcctctgactagttttactactcaacatactgcctaaaattctccatcactcagtgaacaacaaagttgacatgagcatcagtgttttaagaggtggtttaactcaaacctatagaaaacttgaaaataaggtgtttttgaaaatgtgctcaagcttctattgtcttcatgttcaatttattatatgaccttgaagagaggtttatgttcaagaaataataatacagatctcattgtaattaccccataattatgcttcttttttctgaagaccatatggacctataaatgaagtcaatgagttaagagtagggagcattaaacatggtgaaaatatttttatttactgaaaaaattcaacagcgtattgtaaaatatttagtagaaaatgtaccagactgagaaaacatatttggagctccatttcttcagcttactgactctctaaaggcattcccctgtccttctctacagggaacttccatattttcttccaactgtccatttctagccaggggtaagcagatttatctttaagctgttacctgagtggagcctgtatcagttctactcatatcctattgatcagagctgctttgtatatccatacctcactgcaaaagaggctggcaaatagatgctctatctgaatatcaaggtatatatttaaaacttggggcctcttttattataaggagtaagaaagagattgatccttgaagacagccttggctatactaggaatgtcctacacctaaaaaaattagctggcagaacattagtcaacttccgaatagatgcttttaatgaccatgagttttgtacttttattgatagatcccattattatcattttttaaaaaaatcagccaaagttaatgaaggcctcttgagtcctgaggaaatatatgcacaaaatcccttcttgggatcttcgactgtttcttacatgctttgccttatagactcactgctattctagtcactcttccttccaaggacatgctacagtttatagtggccctgctgagttattgacccaggatattaacctggttatgaaaagctagaatgatcaagctacagatttggattattatattttgttgaacagtgcagttattttcatatagataaacatttctcttactgagaaatcattttcttctgggtactgttgagttcttaatttaatcagagaacattttatgtgtagtagcaaacggtactttcagtgagcttaaattttgatggggaaactgacagaataatttgcaaataaatatatgatatgaatttaaatagtgatgatttttggatctgtggctctactcaattatgtttctttcttgctaagagtttaagatattatcgaggttaccaaatagactatttatttagcacttttatatcagtgtttagtttccagaaaggtgaactgggtagccatgtttatattgtacaagtgaagtcacattgatattttattgcaatggaaacagtaagtggtttaaaaggaggaatggtgaagtgaaagaaattatcaacctgtttctttttatattattatctaaaactagtcatttttctgtttttctcttttgcattttttctcatttaagatcataagtgcctgttttaaaaagcagcccaatgagatgaccttgttaaaactcctgattatttctcagtatcgtcaattaaatgaaccccttattgtgtgcccacaatgtacaaggaattatatatacatatatatatattttttttttctttttttttcttttgagatggagtctagctctgtcgcccaggctagagggctagagttcagtggcgcagtctcggctcactgccagctctgcctcccaggttcatgtcattctcctgcctcagcctcccgagcagctgggactacaggcctggctaattttttgtattttttttttttttaaagcagagatggggtttcaccgtgttagccaggatggtctcgatctcctgacttcgtgatctgcctgcctaggcctcccaaagtgaggaattatattattattgtagttatgcaagttgaataaggtaatccttgccctcaagatattgaaactttaacaagggaaataagacatttgcacaagtaaataaaatacgataatactttaaatgtgatcattgtttttcagtattagtgttgatgcccattctacatcttcctctaaagaaaagaagacaatttgcaataaacctttggaaaggagttttgttgcgtctgtacttaggcaaatcgtgactaagaagttattctcctaatggccgcacatggtggctcatgcctgtaaccccagcactgagaggctgaggcgggtggatcacctgaggtcaagagtttgagaccagcctgagcaacatggtgaaactccatctctactaaagatacaaaattagctgggcatggtggcacatgcctgtaatcccagctacttgggagactgaggcaggagaatcgcttgaacctgggaggcacagattgcagtgagcagagatggcgccattgcactcctgcctgggcaacaagagccaaactccgtctcaaaaaaaaaaaaacaaaaagacaaatatataccagataaagtcctccaaaaaaagagccaggaaaagagaaaggagaccaggagggggttgcatgaagaaaatttagtattattatccagtattgccattgtttaacataatttgagttttaatcaaaatttacatttgcataatttaaaaaaccaaataaaatgtaaagagccctgccttatcattttcctaggaatttccgtgcttagagaaaacaccttcaactcctttagatgtttattctgggctttcatgtctgtaattctgggttttacatatatttcaccttgatttttaaaatgtagatattatctattgtcttcctcctatagaagatgaatgtttagctcctttcacctcctgcttagcaatccctttatttggttaaatcagtattcagagatttctttattatgactatataaatttactgtacagctatgccatataatatgatttgactatattttctttgctcaaaaaatttgtcttccttagtttttcaggactctctttggcatttctaggaaacaaaactctccaagggaactctgttcaagaaatctatcaggttttgttttttcccactagatatatgagtgggaagttcaggctggttgatctttagttctgttgcacagctatatccaagggctaacatttgctgctatactagggatttccttcccctgtctcctatgttggatcctccatttcctgaatcctacacgttctctcttcttggtttatttgtgtatttggtagagcacatgttctagtagcttctgaaaaagaatacaaggagggaagtaatttgaggagaaaattttgaatatctgaagtgtctttattgtctacaagtgtctaaacataaagaacgatttgaaattttactattatatgaaaacttttcattaaaaaaatttaaatggttgtaccattagctgttagcaatgttaatcagattctttcttcttttctacttttttttttttttttaacgacctggaagtttttaccatctctatatccctgggcactcagtggacccttttgcctatcagtgatggttcttatgttctgagaaaatctgcaaacacattcatagcaacatctagactcatgttcgaccaaacagttggacaccaagcctagccaagttgatgcataaaatcaacaatcacaagcaacctttcacataatgcctgtttacatacttgttgagtccagactttctttagtttaacttctaaaggaaaagcttactgcatcttcctgaagtgtaagagggacaacttcctggttggggaaggtatttagcacaccttatatctgacttcggaaatctctggggctttcaattccaaacctttctgtctagagttacacaacttgaataaattagcttattgtcgggctctccactgcaagagcttagctttttcttataggtatctataattgattgtcatttttctccttctctcttttttttttttttttttttgtttatttcatctctggggatttcaggagggaaacattattcaatctaccatgttttactgacaatgttcccctagtgtttttgaggttttaatcttttcagaccaaatctttgcagacatccttgagccctctcttttccccacaacctttgtctcatctaataaaaccaattctgctgattttaccttcaagtatatccagaatttgaccacttcttgccacccttacttacaccagccaggtccaagccaccttcctctgttcctggactattcaagtagcctcctactcccctttatctttcttccatcacttctcaacagacagccaaagtgatgctgttcaaacttgagtaacatcccatcactccaccttccatttgcttttcaccatagctaataagaaacaaagttgatattctttaataatcctcatggtctataatgtccatgaactctctgacctcatttccacaagtcttcagatcatttcttcctctccagccaacaagcctcattgctgtccttcacaactgttcaatgctctatctcaggcaggtataaaagtacctccatagcagtgctccctatatattttctgaattaatggataattatatttcaaaaatacctcagtggcattctcctgtttttaggtgtgagcctagcaaaggtctgtggtgtttttttcacaacacttacgaaaagcgttgtgttcaaccttgcaaatgaggaaaaataacagtgacctaagtatcatatattttttaacaaaacaagatatagtctgcacatattcatagcccacgaaaagagcaatgtgtgctttggggtggacatttttttattttttattttttattttttttgttttgcttcagaaattccactttaatgtttttttttttcctggttttatggtctcttacagtaaaacttgcattgaaaagagaaacccttatcctgaagtatctttatcataaacagatgtttgcagtagccagccctgcaatgtgcacagtaaaatgtgctgctacaatctgaagctttcatttacttatttaaacatgtctgagagacctagatcatataccacaggggcagacagcatgctggtgtgtgagcagtggggcatggagggagaaggatggggtaggaagggatgagtagcaagcttaaggacttctgcctccctttcatctgtgattgcaaatactgctgacccatagtagatgactgcacatagattcttgtcccactttcctaaaaaacattattaaggaaggtgcatgtaatgaaacctcatgtattattaacctaaccttactacgaatgtacaaggaataggtttaattcaagtaaaatttataggcaatttgttaaagcagcagtgcacattagaaggtacattagagacacattggttttaatatgccattcaataacttgaacagaggttaaaaatgctgcttaacctccattaagtattttaaaaatgctttaatttaaaattatttggagtgtgtgtacatatatgaatgtacacatatccacactaataaatataacactaaatatgttttcccagttccctttttcagtgctggatgaccttataatgttcagcagtaggcacttaatcagaggccaggccgaggaaggcagggaaggatgtcaacgcatcccgagccagtgacccacccttgtccttgagaactagaggcagagagtgcatattgaagactctgtagctttggaataaaacaaaggctaatttataatgaaaacagcttcctatgacatgttttgtactaatagggcagtgcctcctgcttccccctagtatttacttttggttttcttttacaattcataaaacaaagtatcttgtttcattaagtagcacatcatatttattaagtaatgagctcataaactagaattgtgtacaagaccctgccaatggaattggaatcagatgctgatgttccattaaaaatcaatgcatcaaagttgatatccaattatgccacatttcctagtgtttggtgagacaactttctaggttaacatgtttttcacagagagacctgaatctaaaagtaagaacctcttccttgataaatcatcaggaaggaatcttgtcacaggaaatacagaccacaatcttaggtacatctggaaaacaaaaaaaagtaaaagacactgataagaaaaatttctctgtcatagaaaacttgctaattgacaattacaaagatgataatagataatgtttactgagagtccgctgtgtgccaggctctgtgataaggttttgcctgcaaactttcatttaatatgcacaatatttctaagatggaggtgctgggattattctcattttaatctaattgggggaatgaaatctaattaagtagaagagccatttataagtccaggtccatctgactccagaatgtatactctgaaagagtggaactttttctttttctttcttttttttttttttttttttaagacggagtcttgctctgtcgcccaggctggagtgcagtggcacgatctcagctcactgcaagctaagagtggaactttttctaaataactaactcaatatttatcttacacattcacacaacaaatatttgagggtgagttagataaatactgtttatttcatccactttcaagcatacctcaactcatgattctggcttactgcttcacattctgggatacctcatttgttgttcaaaacccaagtagtaggcataaaatgaaaattaacagagtcctgggaaaccacagagttcaaataatgatgaggtaaattgaaggggtctagaaatggaattatctccgagaacttagttggagaaattctggagatggttggaatggcacaggagacaggctttagagcatgcatttgataaacactgaatgggaacagagaatataagttttgctgtggattttgaatatgcatacacatacatatattaattataatctccaagatgtaatcagagttgtcattatttgggttatttgttgttattggatttgattcttagagaatatgttaatgagggcctttcatgggtattcacataaatagaaaaattggattatttatgaaacagaaaattccaataatgttttcccttacatgagcatattattatgtcctttgtttaagagctaagatatagttttagggtgacattttctttctgcagctctgttccatctgttgctgtgacgagcactatattttaaatttattgtgtctgatccatatacactcctctctagactccctgataggacaggccactctgaccaaccactctcatgactcacagatttatgtttaccattttccttttcagtgttaaagggatcatctcatattttagaggatagaagatatttatccatctatccacccattcatccattcagctatctatccatttcattcatacatctgtttttcaataaacatctattgagtaaattaccagagactatgttggtgttaaggtatacaatcacaaatatactaagacattgtgatttagtaggggaaactgactcacatgtaaatgtatcacaatgtgatgagagccatattagaaatatacaatatagagaagtagtaaagtgaaggaaatgattaattcttgaaggatgaggggtcttaggaacttagagaaaatgatttctgaactgacttttaaaaggaaataggaatcagcaagctgctcaagaagggagtagcagcccagaaaaaaaaaataacagcagaacatttaaagcatacctaatttaattgaaaaacccttaaaaattgttttaaaaaagagaaattataccttgggatgaataatattaatatttatgtattcacttgatcaagtctagaagtaattttagcgtgattttatataaaactaccaaatggaggaaaattattattgttttaatttgaaaactaccatcatcaactatactgaaatatagtttacaaacaatacaacaatattgaaaatattgattcataaagccattaccaagatagtcttttgttgcatggatataggtgagccacccatccctccccaggctcttgtgtaactattatgtccattttctgccttaaggtgagagtagtttcttctaaatgtcttacaattagtgcttagccccagcattgccctcctttcttgaataaagcctagaggttacacttcttttctttctccctctcaagaccttggcaaagcctagttgttcatggtcctcaggagagacattgctgggaaatgggctcttcttttatgcccaggacaagtactgtgctatgcaaatagccgctgcaggagataataccagctgccttgctaataactttgaactctgtagattcttctcctaggcaaagccacactattttacaatatgggtgactctttgttttagctggatgatacatttttttccacttgagatttgtcatgtctaaaaccaagggtcagctaaataatatgggaaaataataaactagcgagctgatttggaccatgtatatgtgaactctcagcactacgtaatgcaaggtaataatgttgtcctaatgaccatgcttaagaatgtggtacaaaatcattcatggaatgaaatctcaatatgatcagttacaatgctacagatatataaagatttggaacatgaagaagagctaacaaaggggtatcagaaatgcattacattaaagtaaattgaggtcagttataattaagccacattcaggagttgatgtttaagtggaagggaagggaaaagattgttttctatagttggaagtcataaaaggaggtaatggtctagaattaggcacattcaggtaaggcaagaggtaatctttaagcaggaagttacctgagtcatcctaattagaactgcttaaaaataggacagctaaaatactggtgggattaacctttataatcaggctcctgagaggaggaggggaattaaccccaaggcaaattcccatgcagtcttttcctggaagccctaccttcactttcagtctccctaggtgctttagcatctttttagttcttctctgcttgtacttctgatttttctgtgacattctttattccccaaaacttggactacccaacttctgcaccaaaatgctatcccctacttgtacttacaggtttatctaatacatcatttcttctaaaaatcacccttaatttttccaaattctctgtggcttggagctattgcagtaagtctaaattaattctacttgtaagtatctgtgctaatgggtaatttatccaaattggagagctgttagcacattcatgatgccatcatcatggatttaagggcctagataccttcacaggaagaaaaatacaaagaatcacaaccacagtggccttgaatttaaatggaagccttctgaatttgactttgatcatgtgatgaatcaggtacaagaatatatactaattgtcatggccatgctctatttctggatatgtatatataagggaaattgctgtcaggtggtacaaataaacaaatagcgtaacctggctgtaaattatgataaaaatgatagtattagttgatttccgccaactgaatggcacatattttgagctctttcttttcctctcattgagcacaatgttttctattttgctgcccttgaaactttgtaagacagaatgtataggatctaggggaaggaaaaaaacccaattgttggtaactataagaaaatggcttgttttcaacaagagcctggaatgagttttagagtatcctaattactttttgctgttccctatataatagataagagaatagattcactttttgctcatgctctccttctttcaatatcattgctattttatgaactttaaattagtgtcatgacaattgtacaattcatttttatttgctgtaactgtattcattagaatccttctgtgatccttctaccccattgtttcagtaaaattctttgcagcattttgcacgggcttgtgtgtgtacccatgggtctgtgcatgtgtgtatatgtatatgtacacatacatgaacacacacatcacacaacactaagaaccatttctccctcatatgcctgctccacattcaactgcctgataactttctaattctataacagttaacttccatctcctgggtctgaagagattttaagtaatttgaataaacttttgaatcatatttgtatttctttcctttttccataagaaaaaaaatatgagttttagaggtaagctaaagtctctaaattctgcaggctttttttgtgtgtgtactacttgcagggctcacagcctgtttaataattgaactcatttttatttgttcatcgaatgtgtttggaatgcctactatgtgccaagcagtgtactggctgctagggagacaatgatgaatgaagcagatgggttttctgcccttatggaagttagattttggtggaaatgagattgattataattttcatgaacacttaggaaacaaacaggatgctatgcatttgtaacaggtatacctagcctggcctagggaaagttgcctgaggaagtcacgagacctgacttacatgagtgaactgagcaacagagataggtcaaaatcatcccagcagacagaacggcccatgaaaaggcctttaggtctcaagaagaggaacaaatatgactgcaatggactgagcggggggatgagccatgagctaaagctagagacgtagctgggacctgactgtaggattgaaagctgagtgagagatttggatttatttcctaaagggaataggaagtcatcagttagtttcaaatagagaagtgaaatgtccaaactgcactttggaaaaagactgctacgaagaatagattggaacaggacaagagggatgcaattagaagagatggcctccgggactgggtggtctgggtgtaaacctgggttttgctatccattaactctaccattttaggaaagtgtgttaaccttctcaatcttctgttttccaattgacagaatagatgtaataataattcatgcattatttgcatttctatgacaactaaatgagatgctcaagataaagcccctacagtagcatctagtttgaagtattagttataaaaaaagtggttggtgactttatctgggaggtcgtagcggggatgaagagtggaaggtttaaaattgttaggaggcaacatccataggacttggtaattagcaaaatatagggggtcagagaagtggaggatgcaagcttttgttttagtaaaatacagaattagtttaatttgaatttcagataactttttttagtctgagcaaatgctgcatgggctgcacctttgctaaaaaatttcattatttgttagaaattcaaatgtaactggcttcctatattttataagtctgccctaccaaaggtacctcagtgttctaggcaaagcaactgaatgactggtaatatctgttggaatggagctgattagaggaggtcaagttttttgtagaaatattgaaatattgcatggtagattttaaatacattgaattgtaggacctgggaggcacccaagtccaatgtagataatttactcagtttttctttggtcataattgacacactgaaggacagatataaccacatttgtattgggaattagtgccttggtagagtattctgtttttctgtgtaatcaattattatgctttaaataaaagagtggataaaaagtatatataaaacttttaatttctttatttctaggtttttatatttctccaggcaatgccactggctgcctgccatgctcatgccatacaactggtgcagttaatcacatctgtaatagcctgactggtcagtgtgtttgccaagatgcttccattgctgggcaacgttgtgaccaatgcaaagaccattactttggatttgatcctcagactggaaggtacatctttataagctttaataatttaactctttctttagcaacagttaactttttttggcagttgcaaagcaataacttctgtaaaaagtattttttttgcccggcttggtggctcacacctgtaatcccagcactttgagagaccaaggcaggcggatcacgaggtccgaggtcaagaggtcgatatcatcctggccaacacggtgaaaccccgtctttactaaaactacaaaaattagctgggcaaggtggcatgcacctgtagtcccaactactcagaagtctgaggcagaagaatcgcttgaaccgggaggggtaggttgcagtgagccgagatcgcgccactgtactccagcctgggagacagggcaagactctgtctcaaaaaaaaaaaagtgtttttttgttattgatatgttttttgttccgtgacatccacatttacttaatgtatgctaatctttgaatatttcctagagtgggttgctatatattgatagatgtggcccatcctagcatctgggaatgttgaatgagataaaatatattttctctcaaaaagctgagagtctggatgtggagaaagacaggaaaagacatatctgaagaagaaaatacacatactcatactttctctctctctctctctctctctctgtctctctgtgtatatatattatatatatatattatatatataatatatatatatatatgggatatatgtatgtgctttgttcttcattgcccttgaatttattgcatatttattagttcattgcatctatttatattttccttgcgtttctaatttagctttaaagactggcagatgagaaacatagctttgtattctgtgatatgatttttttcagtatgtaaagtatattatgaaagtaaatcatttttcaaagttacactctctttaatattctacttcttattctctgggtatctgtggccatttgccttcactcatttgtgtttattgctgtatttttgaagatgtgctataatgccaattctgtgtctgtgtgtgtgtgtgtgtgtgagagagagagagagagagagagtgagattatgagcttgtctaaagttcagactaaatctatgaattctttgaagctcctatccctgagaagctagtagtgtgtgctgaactcagaaagcatgtaataaaatgagtcaaatctgtctctcaatatgtgtatatttataaatctaattgctaattatttcagggtttgtgattatctgggctcttttaaactcattgcccccctgctgcctgccttttggctgttccactcctcattaacacctccattagagggtggacaggtgacagggtaattactgaaaaagaacttaaactagttcattttgactttcttttaaaatttgatgtgatttttaaaaactacaaaaatcatttaaaattttattaaaataatttttgttttcttgacatacatgcatatattttaatctgtgacgctctacttctatcaccgtagaaatgttaccttgatggtctgagaccattgtgactcttttctacagatgttattataaatcatctaaatgagtatacaaagcgcatggtacagtaaatagtaaataaaaagcactgtcaggattttgatagtaaaataggagccagttactgcacatactagctcctagatgtaatttttttgaaataatattctacagattccccagttggaactcttgggctggtttgtttcactcctggccacctctgtctttttcatagttctgaccacatttaccaggagaaaaatatcttccccaacccactgtcctccttgcaacactcattcccatcagtgccattttgtgacattcaattacccatttttgttctactcatcccctttgtcagtcttcccagggttatcagcaaaacgcctgctcagtgacctggggatgtctgattgtctcagctttttcacttaactttttttctttaagtgagatctgattcccttcattacactgcttcctctaccctacaatgttcttaaattcgtggctgagccttttaccccattctgttcctctcccattatctacccatctcactctcactccccaccttactttagtccaggaacaagaattgcttaataagtactgttccatcacctgtcactctgcagtaggcctgactagcactggagctagattccctgggttagaaggtggatttaaatgtttacataaattgataaggaataggaaggaccaaagaagtgggtataagctacatttttagaagataccgaagttacaataaagaaagaattcagtctaggcactatggctaactcatgtaatcccagcactttgggaggctaaggtgaccagatcccttgagtccaggagtttaagaccagcctgggcaacatggcaaaaccccatctctgtaaaaaataaaaagttagccaggtgtagtggctcttgcctgtagtcccagctacttgggaggctgatgtgggaggactgcttgagactggaaggtcgaggctgcagtgagtcaagattgtgccactgcactccagcctgggcaacagagcgagaccctgtctcagaaaaaaaaaagcaaaaaagagagagagaaagcagacttcagattcgcaaaaagaatgaggggcaggttggagtctagaaaatagagctaaagtatgagaagctgagtagatttctaaaaatatgaatgattcagattaagtgtggggttttttttttggacagagtctcacactctgtcgcctaggctggagtgcagtggcgtgatctcggctcacttcaacctctgcctcccaggttcaaaagattctcctgcctcagcctcctgagtagctgggattacaggtgcatgccaccatgcctggctaatttttttgtatttttagtggagacagggtttcaccatgttggtcaggctggtcttagactcctgaactcgtgatccgcccacctcggcctcccaaagtgctgggattacaggcttgagccgagtgtgtgttttaaacaaaaagatccacaagttttatataaatgagtttggatatctttacatattagttggctcctgttatattgatgggggtggtgagattacctttttaaaattacaaattgtccttggaaatggtcgcacttttcttccatccctgtattagtccgttttcatgctgctgataaagacatacctgagactgggcaatttacaaaagaaagaagtttacgggacttacaattccacatggcttgggagacctcacaattgcagtggaaggtgaaagacacgtctcacatggtggcagagagaagaaagcttgtgcagggaaactcccctttttaaaaccatcagatatcgtgagacttatttactctcatgagaacagcaggggaaagaccctaccccataattcaatcacctctcactgtgttactcccacaacacatgggaattgtgggagttacaattcaagatgagatttgggtggggacacagccaaaccatatcaatcccctttgttcttatctttccagttccaggttttccttttcagagggattctatttttctcccttttctaactcctgccattattttaaactactttgacatgtactgatgcagttctttggcctcttcattcattccccactccagcaacccatttccatggctacaccctggattttgtgatcacttataatttctctatttctcaaatcttcctaatcccatgaatgctattctatggatatatcacatctttccaattccaattcaccctggaagcctcacataacctgctccttaacttctcttaatctttatcccattatccctccttaatcctcttttgatcaaccccatccctaacttcactgtcttctacttctagcctgaggcaaaacctttttaattatgacccttttgagtacctgattgtgggctcccttctgctgtactgtggggtcagctccagagacgatcaccctacacctgccctgatctgtgaggacgtggggaaagatcatgtgcctatgctgatctgaagcactaccatgtatgtacttcttatcaatttactttctttccccctttaaactcctaccagtctcctcagttttaattccatgctcttgcccttgcagataatctggccctctgctcatagacaaaataaagccagatatatgtatctccagattatcttttctccacctccagcttgtctacattgtcacacatttttaattttttatctagtcttagaagaaaatcctgtgtatttttgcctaaaaataacctgttcccagtccttgatatgatcccttcctgttttcctactcttgttcctccattccatgatctttgctccatcaaatcctccctttattttaactcaaacatctctctataggtaatatcataactgcctacaaaaatgctattcattctacaaactccttcctttgattctgccctgctttatgagccctgaaagttattgtctaatctctcactcttcattcacttactaacatttaaaaagagcactatgattcaagaaaacatgatttaaaaaataaaagatcagattttttttcttcttcattttgtttctttctcattcattctttattcaccatgtgtggtacatacatgttagcagaacatacaagttagcagaacttgcaacatgcagacattcaagaactagttatgtgactattaaattctcatccaaatcaaagacaaggtctataaagagatataataaacaaaaatgggttaaggaaaagacagaatgagggaacaggtttcactggtgggaaaaagggaggggtcagtggtgctttccacttgagtccagtgagaaggtcttatttgatcccttgaagggtgacatgtgtctcctgcagttggagagaccagtgcattgatatctatcttagacctggcaaatctaactgagaagagacagtctacccaggtttggataggtaagctagaagacagtgccctgcatatcttagactcccagagttcatcatgacaaggaagactacgtatttctcatgaccggatgaagaccacaaggaagaaagacagggtaaggttgtcttagtctgtgctcaaagtaccacttagaagataaaggggcctgtgtagaataaaggacaagattactgtggactacaggttaataagcaaccagtcgaaaagaaaatgcatctgactgcactaaaacaaaaggtgagagatacctaatggtgagaaagatcaatgaagaagtcaggaatgtaccactgtcagtgataagtcagttttatgtatatgcaggaccagagacaatagactgctttgggtggttctagtccaagtgagtttctacccttcctgcagcctctacgtgagggaggaggctaaccaagctaccttctctgattatagacttgctgcctttatcatgtcctagcttgatgaaaggaagagaagtatgttcttgaaaatgtctgttctttaaataaagattggaatgttgactaatatacaggattagactttctattttctgaattgaatttgtattttgcaatgtaaagtaactgtaggacattctattgcctgagaaagaccagaaaagccaagtgactaactcattttatatccacatggaacatgggggaattagctccatattatatgtttaaagggtcagtgaaagacaaaaataaaactgatttatgattgcttctcatgacttatggtttctcaatgtgctggtcatttcattgttcccatttatttcttaaaattacctcttcctttggtttccaagattctacttctcttatttgttttctaactctttttttggctactcctttttaatatgtcctttcaatttccacaactgtgtccctgatttcaaccactacatacatgttaatggctttcaaacacatgatcacccattcagatgcctgccacgcactctaggcctgtagccagctgtctctctgagttttacgcttgcaagtccctcgtgcatttcatttttaatatagtcagcacagaactaaccattacttcctcatctccacccaaataaaaataagtcttatgccatctcatgctatcatcatcttggtgaaaaagacgtaaaacttcaaataattattcaagtccaaacttcccaagtttgagtggggcttagattcttctcaggtttggcagaattggctctgttgttgagtagaatgagtctacaggctactgctggaaagtgctatggaaagcaagagctactgtatataatgcagcttctctaaaaagaatagaaagaataaagcttcccatggccatatgggacccaaggagatcagcaggatttgtctcttactaaatcagtcgtgtggaatgctggtaacttgacttgaccctcctatcccactgatgaattcagctgtctcttttcacttcaacattgataatcattacacaggaaatcctgtagcacagaagggcatggagaaggatattttaaaatgtgacaatgagaattgcttgagtttggacttttgttcaacattgaaaagagataaaagtgggttctttttaatgtttttccattcctcttttgaatgataccgttcttgaatctttttttgacttctggttgttattgtatatacaccaacattggctatattgaaaatgtgtaacaattgactaagatatatgggattccatcaagtataagaaatttttgttttttaaaggaaaaaattcacatgtaatgtaaatatatacagatatgcagtataggaaaacagctatgtcctaatgttaaaacaatgtttttgaaaacaaagtagattcaaaatcatttgaatctactttgaaatctaggcactgtggtaggttattacaaatagaaatgtttacatttataaaaattacattccaattataacaaatggaaattaaaacattaattttcaaaatatacagtagattataagtaacttattattatgaaaggggaagatacaagtatcatattatttcttcatcaacttggaaaataacctcacttccttatctgcctggttcacatattccttaccttcttcatgctctatttgttggatatagcaaggtttgctatattgttttctcttggtttatttgctacacagttttttgtattcccaagggcaaaataaataaaataaaatagacctcggccctaaactacacaaccaacaacaaaaatccaggcaacacaacaatgactttttgtgaccaagctggaaaatcatttgcctgtttccatctaagtggtttattcttcaaaagttactgaccagaaaaagggggcatgtattttaaaaagctgatcctagtgcaaacattactccatttacctctgacacataaagcaaacatgatttaatcagtatcgaaaacaatgaagcaaaaaaaatctgcccactgaaaaatcaataatgcaaaaaagtatatagtgtttgtctaacccaaaaacaatgagacaaaaatgggccatatttaattcatctcagttggtagtggagacccatatttgacaccctgcacttactggcactgtcctcaagttgacctgtgactatgactactctcccccatagcccccaggactgctccagttcatctggtaccccacagttttcttacataacaaccacacatcacaacccccaaaagtttcttccctaatgatataccctctctatattctatgttaccttgttttaagccttaaggagttagtggtatcactatttgtcccatttactagctgacacacactgaagttgtccatagagggtaggacaccaaggctggttagggagaataaaggctcagacttctggagcataaaatacagggaagttcttctatgcccagattatttttggttttactgcaaatgttctacatttcagcactaggttatagatttggtccagtaatcttttcacaggcctttatccgattgatctcaattggtcttttctctgagaaccaggtcaatgacttcagatgaaagcagataacttccttgtcaactgatttccttttatggtgtgataatggaaaaattagggagtgtgcctcatagattccctctcctcagtgactctttgtcagacagctggctgtcatctggggtgacagggtaaatgggccacaagcctgtcatcatctggcagccaaggcagggctttctcacaaggcagtggcagatttccaagaaagaaagcagaagcatgcaaagacacttgaggcccgaaccgtcaggatgttacttttaccttattctactggccaaagcaaggcacgaggcttaaccatgtttggaagtggtggggaataaacagactctccttttgatgagtagaactaattatacagttagctgcaaaggacctgcacagagggaaaggtgaagagttgtgatttttgcaatctcctatggctgccaaactatatattctctcttagtatagatgatatatgatctgataagaagtatcagtttttatatattagtagcatttattcaacgtgatgtaataggaataacatgcaactggacatcaggatatccaggtttcagttttgtcttttccactagaccagatacagtagcttcctattattggtggaataaattatctcaaactcagtggcttaaaacaacatgaatttttattatcttatagttctggaaatcagaggctctaaatgagtttcactaggctaaaatcaggcctgtgtttcttatggagattctaggaaaaaaaaaaacatttccttgattttcccagcttttagaggcaacctacaatctttttttttttttttttttctgagatggagttttgctcttgttgcccaggctggagtgcaatggtgcaatctcggctcaccacaacctccgcctcctgggttcaaatgattctcctgcctcagcctcccgagtagctgtgattacaagcatgcagcaccacccccagctaattttgtatttttaatagagacagggtttctccatgttggtcaggctggtttcaaactcccaacctcaggtgatctgcccgccttggcctcccaaagtgctgggattacaggcgtgagccaccgcacccatcgtacattctttagctcatggctccttccttcattttcaaagccagcagagcagtgtttccttggacctctgcttatgtccttacatgttttctctctgactcttaccctcctgccttcctttataaggaccgtagattacattgggcattcttggataatccaggataatctccccatctcaaaatccttaaccacatctgcaaaattccttttaccaagtaaggtaacattcacaagtttggaggattagaacttggatattgttggcgtgggcataatatgacctgctctaccagagttcagcaatctatagcctgggggtcagccacatgtttatgtaaatagagttttattagagcacaccaatgttaattctttacatattttctgtggttgctttcctgctacagcagcagagttgagttacaatagagctcatatggcctgcaaagcctaaaatatttactatctcatcctttatagataaagattgctgaccttgtaactagatttactgtcaccttggacaaattagtctcactaagcataatagaatcataactttatagactgggaaagaaccttaaaagtaattttggttaaactctaccctatacatttctctgcgtaaatcaccttttcagaaaaactggtgaatggccattcagcttctgctccaaaacatggaactaaaaggagctcactgtctcatgaagtagctcatgtttatttcaaacagctgtaattcttcaacaaatagaaatatattatttatattgaccaaaaagttgcagtcttttgactttcttgcctagtcttatttatgccttctgagaccatagagaataagtgaaatctctcttctatctgtgagcactttaaaaatttgattctgctatcatatctgaaagttatttagttatttgcataaatatgtggagtgtcaacaaaggagaaagagacagtgttctcagatcagaaccttgctgagcaagctgcctggacttagctgtcactattgcatggatgcaagggagtcactgcccctggtccagcttttatgagtttctctatttgtgcctgggaaattcaccaaagagggtggggttgcacactgttaacgtctccctttcagatgaggcactcgtatttccttgttcaataagccatgtaaatatggctttcagttcacacagcgtggatgcccaagcctcaaatccctctcctataattctgattccatctccaagagaattcagatgctgttagtagtctgtaactaaagcgaaactaagaagctcaatgaaaccacagctcctctgttaatcggggaaaaccaaactcctctagagggcactgtagcactcaccgaattctgtgaactgagaacactggtttaagagaatctgaacagataccagctcttaaagaaaactgtccattccctgggagtgaggttagccagggggacagagttaagccaataaaaaggggctcaaaagagctaacttgttactagagctacaaaccatgtttggattaatctccggtgtcctatcctaagtctaaagcttccctggtgctttattcactattaattcctgtatccgacaatatttactgaatccttactgtgtgctagcctttgtgttagggactgatggaaaaaactaagacaaaaacaaacaaaaaaactctgccgaatttctccaatttgccttgaagtctcattctcttttgtttattaataatccttatctaaaatcccttagcaattggagatctctttctccttcgttctttatgttgaatgatgtcttcatcatccccattagcaagttagaagaccgggagtaactttatacctatcctcccttctcttttcaattcggcctcccattctaccaattttacttaacatttctcaggtctatcctactcatttccattgctccttgccactgccccaaggtagcattatcttacttctgctcacctttccaggtttatctatcaccatttctcattatgaatttacatccaggagtactgaggtgcttgcaatttcataccctcttctgctttttcttttttttctctatttttgcccctccccgacttccctggcttatttctactcatcttttaacgttcagcccaagcatctcctccaagacttctacttaaaattacccttcccatcccttcttctgctaccagactagttaagttgccccttttctggacctttagagtctggatacatctttattaatgctgtttccgttttttcttgcatacgagattgtgagctccttgaggaccggggcaattctataagattcatctctacatccttgatgtttattccagtcctggaacatagctggccctcaatgaatgttatttatgtcaatcaatatttaaatcaatttgatagtacccatgagctgaggccccatagagaggaggggtgtacaaagagaaatgtcaataaattgacctatatatcttgggatatatctctgggcctcctacagcagttctccctcagatgatgaattttctgacaatgatgtgcattactgaaacatattcctttcattaatagttaggtttcaacagtaataattaggataaccatttctctcactgtttccacaactggaagaaattcctaagaaaggaaggtatatgaaatttgtgatgtaggagacagaggccaacttctttcccattgtaaccagcaaatactgagttatgtaagggtccaaagagaactatcatagcaaagtgctggcagagattagtgatgctttactcctgttttgtttaccataatgaactggtcaataaacatcacaaattgtttatctatataaatcttgacagattactctttatgaaatccatttagcaagcgaggttttcccataaggatgaaaaatgaagattttaaacagattgcgggagaagctctggctgtaccaagagagtcagtgtaataaaggtttctttatattaatattacaaaaaccatttatcctggcaaaatcaatattgcaattcatcttagtttggtgtttctctttctaagcttaaaatgtcttttcctttattatgtataattttgttttaataaatgtgaaatatatttcatttaggaggtactcttgaggagggataacttataaaatgacatcaaatttgtagcttatttgctaaagagtcttggaagtgtttaaaattatatttgagtggctgagaaatctaaaggaatcattttgcttaatccttaattacaaaattatccctgtgtcctttggggtaaaaacaaactacaattttcagaaaagtcttcgcttgtgaacttcatttaggaaaaattctctcttactgaagtcaagtgattataacaagtcagataagttgactataacaatggcttggataagagactataaaatcaagaatagacacatttaattgctcaaaacattgcgtgctttggctggaagaaaatagaactacatcaaggaacggaattatgttatacattggaagctattactctaaatgtactgtatgtaaaataagtgtgattgtctcatgagtgaatggtaataaaaactgaaatactcaagagacacttattcatgagtggtgcagttacacatacatatatacacacacacacacacacacatacattgagagaagcttttctcttattgtttatgctcactaatattatattaaaagcctataaacaatagactctacataatagcctataaagaaattaagagcaaatcaagtatttttgcatctataattccattttaattataatacataattttcttcagctctaaaacttaacctaaacaaaacatctatttgaaatggaattctgatgtaatgtgtatagataaaagacctaatatagttgtttgaagggggaaaatgtccttttatcatgaccataaaaacggcaaactacagtacagtggttttcaagaaaaactgtactttatttattcccaaggggatattagtccataaaacaaatttgcagcttatttggcagtcttagcttttatcagcctttttaagggtgttgaatgattacccaagagatcacactgtaaaaatggcagtggggaaaagtaactccatccgttcagcatctttattagaatatataggtgaatccatttgatgttgttttaaacgtaccacaaggagagtaccttttaaatggtgagtggtcttcttacatgtgctgttttgcttctctaatacctcatggcaccaacgttgcttatcctaattagtgccattggcataggctacatgtttgaataattcactgtgaagaaacaagttttagtttctatcatggcaaaatgccactactggtatttttacaagcaactttgggtccaagaaatttaagttgcactaaagttatcttactatatttatgtcattagcatcttttcataaatcagaataatgctgtattctccaaccattatggataactaagtttagttcataaaacagaaaatgaaatataacccatattaaggcatcaaaaatatttgaacctgtctttctcaagcaattttcttagtgaaatttagtcttcatcgaactaactatagaattttaagatttttagggagagcaatgatttacccctgattttctatttcgcaattggagagtcacttgaaaagataattttatgggtacctaatctaaatgtttagctgacaggaacactgcttttgtaaaagcaaaatttacagcattcttaattgaacaactggattcaaactaatccataagatatattgtgggatgtaaaaaagcaatataatatctttttttgctattaattagtttataaagagaaagctttatacgggttttaccaggaacagtagttttataaagatcttttctattttcctttattttatgttgattctttgtttgtttagctcaagcattcttttcaatatattggctaaaacaagccgtcttactctacaatgctattggtaggtgtaacttatactatgaattattaatcaaaacactattctctttgatggtttatttgccttgttttcagatgtcagccttgtaattgtcatctctcaggagccttgaatgaaacctgtcacttggtcacaggccagtgtttctgtaaacaatttgtcactggctcaaagtgtgatgcttgtgttcccagtgcaagccacttggatgtcaacaatctattgggttgcagcaaaagtaagtgaactctggttcagtgctggtgtgtgaagcagcatcatacaggggactgcatctcattgttttctttctccatttagaacccatcagaaaggcttagtacaatgtgaagaacgtaggtaagagatggaaaaaaatacactgaatgaaatatgtctgcttttccttgattagacaattggaaatggtaatataattatgttcatggtgggaaatttacaatagttttttggagtgaaatcaacaatgaggtgattaaagtcctaggttttcccagaccaagggtcttcccaggacacaagacttttaatggtaaaatcaggactatattggttaaaccaaaacagttggtcaccgacacaaagacatttccaggtaagttatttttttttgacaaataaagggtgaattcttgtttattatatgtttgatattcttccatcccccaaattttgtgggcagtattataccattagttgtttatcgatattgtaataattagtatcattcgtcacgcatattattcatcccataattcatgtttctttctactttaagtttcactcatttaaatatctctcacatttatatttttaattccttaaagcctaagattacatgtaagtatcttttgacttttcaacatcgcttttcagtaccttgaattgacctcacaaggtcacctgcagttctacaatttcataacatattgaccgttttcctatatttacttcaagatcatacatccttaccctttccagaatccctaagaaatgcctgctgggaacatgtggtaggagccctctacaacatattgtgctatgcatattctccttggggtgtcctgagactgtcatgagtcacaatgataggaaacgccacaagtcatgacagatcatcacaaaccagcatgcctggaactctgctatctacatttaaggggggagggagaaagataagtaatgggatattggactccacaacaactgtactagattttgaggtaatggaaagcaggatatagctagtgattaagaagacgtattcatattttgtacctgtgtagtttctcttcagcatcccgcatttcatcagtccctctggatttcagtataagtaaaactgtaggtatttatgcttcttttgggaaagaactgtcataattcctttcatgtataaatacagtctaaacataaatctggacttcattggccacttaattactatgtgtcatttattgattagcaatacaattgattgctttgtatgcaacaaaaattctagcatattccttttggatatgagttatggatcgtcatttataatggaattacaatacctaatcttagtgatttctgattggttctgccactaattttgtgacaatattggcacctgctctactttttgctacctattccttcttgcatttgagacatagtctgggaattatctctcaggcaaaactggatagtcatgtcactggaaagctagcctacaactcttagtagtggtagacatttaattttatgttttattaactggacattctttccaagtgtttctgatttgttagaatttttaaaaactctcacattcctaatgattcttccctggacatattccttttggttttttatctctttaaaattatgatatatcatactgagcacagttcttcaactcttgtggttgttgctgcttctgttttaggtttttatttaacaaaatttttgaaacactgtgtaaagttggaagctcagcatcagcagaggcaatttattagaaacaaatgagacaactttcctgccttcagaggaggtcaaaacatagctagagtgatggacactgataataggaggggagcagaaaaatgtaaatggtgggatgaggatgaagggtcccagccttctctcctgttccagcttgattttcacatggtacttgtgtttgatcctagcagaagccagccagaacaattggcttcacaaagatatgatgaaattgaaaggaatgtagtgctatctattgctgacacagtgaactacctctgactagtatttgtctctgtatccaacagatgtcaagaaatattttcatttaaaattaaaatttctcatggtaccccaccccctacacagtttgggaactgcaggattataaccctcattatatcttctaggggccactagcaataatttagtaatatcatctgtgatttttatttttggtgggctgtcagggtgggaatcctaggatgtaatttccaaaatgcaagaggattgaatgaaaataaagtagttagaccttttcttatagtaaatttcccttttgggtgattcacttctttcctttaaatattggtatcatgctttcaaaatgatagtcattcttcttgataggaagcaaaacaagaattaacataaattaaatagtcctattttctgtatgctttcctagcgaatgatattctagttagttcaaccatctatgaacctaactaaaattatacacatacacacacacacgtatacaattagccacttattgtttgatagtgtttgtcttcttgacactattctcattgttatttattcatctttatatccacattttttctttatctctccttgccagagagcctcttctagctctccttttattaacagctttattaaagtataatttacatattatatatttaacaattttaagtatatggtttgatggattttagtaaatttagacttgtgcaatcattactataatccaattgtagaacacttctgtcatttcaaaaagttcctttgtgcccatttccagtcaatcatgactcccacctctagccccaaacaactagttatagggtctttgatgagataattttgcctttcccatgagttttatataaatgaaattatacaacatttagactttttgcaatgtataggcttttgtatctagcttcatcttaacaaaatgtttttgaggttcagtcatattgttgcatgtctcagtagattcttttaattgctgagtagtattttatggatacactatattttgtttatccattgatcagttgacatttagattgttttcagcattggtctactatgaataatgcatccatgaacatacagttacaagtctctgtgtggacatgcatctttatatctctttatatcctgagaataaaaaggctggtttgtataccaaatatatttttaatgttttaggaaactgccaaattattttccaacatggctgtattattttacatttacattagcaacttataagagatccagttactctatggtctcagcaacatttggcattgactctatttcattatagccattcagtgagtgtgtagtagtatcttgttgtgattttagtttgcatttttcctgctgactaatgttgaacaacttttcatgtgtattgtcattcatgtgatttttggcaaagtatctttgaaatattttgcccgtgttttagttgttagtcctcttactgagttaaagaattccttattaatttgggataaaacttgcaaatagtcctctcattctgtggatttgtttttcattttttttattggtatactttaaaaagcaaaagcttttacttttcatgaagtcaatttaccaagcttttcctttatgggtcatgtttttgtgtcctatctaagaaattttggattgactcaatgtgaaaaaaaaaaattctccatttttatcttacagttttatacttaaacatttacatttagatccatgaaataatttgaattagttttgtacatggtatgagttaagcatctaagttctttatttcatttttattttttgacacataggtatccaaatgttccattaacatttgttgaaattgccatcctttccccattgaattacccaagcatctatgcaaaaatgcagttgaccccatagctaacatcatattcaataatgaaagactgagatctaagatcagacataatacagaaatgcccacatattagccagagcaggtaatcaagaaaaagtaagtaaaagtctcccaaattagaaagttgattttctttacttgtagatgatatgattctatatgtggaaaatccaaacaaattcacaagaaagctactagagctagtaaacaaattcagcaatgttctatgttacaagatcaacacacaaaattagttgtgtttctataagccagcaatgaataatttgaaaaagaaattaataaagcaatttcacttataatgcatcaaaaatttaaccaaggagatgaagacttgtacattatctgttttctgtgtttccaggaaacctatagtataattgcgcaatgttatttctatgcactgttccttttatgcttagccatgtgctctccagtgtctcatgagtttcatgcaggatctgtgtgtgatcacttttctattaggatgctaagatagaagtaattttcccattagtatatattatctgtggtaataaatatattacttattgccaaataagccatttataattcttgggatgtaagaatcaaggatgccttccagcacactggagggtagaggaaataaaggtgatatttattgaacaattactttatacacatatacacacacacacacccctacatacatatgtgcatgcacacacacacacacacacacaaacacacacacaccttatcttcaaaataaccctgacggggagacattatcattctcttaatataaatgagaaaaggttcagagagtccaatcaatatttgactataatcatacaactaccaaagttccaaagctggagattcaagctggtggttcccaaagagatggatctagtcacaatattatactctcatcccataaaagagagtctggcatatgcaaagaccattcttggcaattttgatgagtgaatatgtgaacattttttaggaattctacttcaagcacataaaggttcaagttctctcatgctcaagatttaataatattattctcaaaagtgttggtaagtcatctaaaccttctggcttatgaaaatttcaacttaaataccaaagaggtactatttatttatgctgtggagtcagacaagattgtggttgacatggtcatagcaagtaatcagcttaaatgtttggaaagagcctctgtgtgtgaagaacttttgttgccaaggatattttcatgtaatgcaaatcattttctacaccctttgacatgggagtgaaacatctatctctctttcattttcattcatccccaaagcattttgctgccttagaaaatcatctgaaggtcagttttgattgctctaactctgaaatctgttgtgttcctgatagcatgcagagttttagatgaaatcactaatattcactaaaaaatgttaaattaccatgaattgcaaggttctttgagagtgctgtaaatgaggcagttgatgatatttgtggctccaccaagaacaacaggatttaaaaccctaaattaaaatccactgaaagggtcaaatgcattttcagtgttcaaccgatcaaagtgaccatatcaaatatggaaaattcatgaattcaaaaatgtaaggtgttattcggaaataattcttttctcatgtgtcattatgagattgttgctactcttttcctatgtctaaataggcatatagactgttggaatgttaatagaacaatgcaaattccaaagaagaaaaagacaaaaggagggcaatgagcatgtatctagtttgaatattttaaaacatatgatgtaaatattatctgccttaggatcagactttgtctttaggaagcctattcatagtacatggaattttatatattttacattcagtgctgtgcagaataaaacaacattttccccctctgttctcacaccaccatcaacatagttgaacaagcaattctgcagcattaatatcctacaatccagttcaactcttgcgctatatacctggaagtagtggcagattccacgggtgaggggtcagtccccaaggctgcccccaacttctaacaccaatcacaagctccaggttattttgcctgtgcttgtaacccactggctataaattggggctcctatgactccctccttgggttcaattactttggcagctcagctcaaaataaggaagcacttatttttactgatttatgatacaggatattgcaaagatacagatgaagcaatgcataggacaagatacgtggaaaggggagctgagcttccatgtcctccctaggtgtcacaccctccaggaacttccacgtgttaaactacatggagctctccctgtacccccaccaccccccaccaccccaaacaccctttttgttgttgttgttttagacagagtctcgctctgtcgccaggctggaatgcagtggcgatcttggctcactgcaacttccgactcccgggttcaaacgattcttccgcctgagcctgccgagtagctgggattacaggtgtgtgccaccatgcccagctaatttttgtatttttagtagagacggggtttcaccatgttggccaggatggtcttgatctcctgacctcgtgatccgcccgcctcgaccctttatagcaacttcattggataggcatgactgaagcatggatgtggcagactaccacaattactacttgagaccatcactacaacagttactactgttactatttgagactgtcattacaagactgaatgaaggaggatgaacgcagaaatgaaaacttaaaacaaaaataactattttacaggaagggtaacatggggaagaagaagaggggtccctgcttcttgtgagcaagggcagctgcctgagctgcttcagcccttcatatttattgggtagaaagagcagggaggaggagggcatgattggtcagctgcttgattgatcacagggtcatattattactaacaggcttcagatttgcctaataacaagaaacacttgtgcctgggtcatgactgccctcagcattccttccgggtgcagacgcagtttgtcagcttgccaacatcctgctttcatgagaacagtttgctgtttactcatatagcctccagtggtatacttagttgatcacgaccctcattcttttggccttcaacacatggacaactatgtagaaatgtgatttaaaaaaaaaaaggagtatgatttcatactaatcgactgagtggggaaaccctgcaaggctgcctattcagagtcttcttggcctctctctgcagtattcattcctccagggcatggggcaggactccttctaaaatgagggtctcatgacccacagtcagacaaggtaggtcagagaatttccttatggccggctctaagacagaaaggtggaggaacattagagtatatttttagtttccctggcctgccttggggagaaaaaggaacaggtagaagcagaacagaacagagacagaccctattttctgaggcctacttctgaagcctaaatctccccaatattgtaacaaaagactgtccttcacctgtatcactcttaaattgttctgaagctgcttcaggacccttggataaaagaccaatacttcaacaaaagataggcttattgtgttagtcaccaaggaaatagcaaaggctatggaagttatgagccaggaaccatggacaaaaacgtgtgtgtgtgtgtatggtgtataaatatcaaagtgctcttgaaatcctgtcttaaaatgtaataatttgattatattatatcttttagacagagttcatatattatatctattaaaaagagttcatcactcatgggtcctggtgaattagcaatagctctggggtggaagtctttgcttagtttgcagaataacttcactttactgttccctacttttccactttgctctgtcctccaagattctatgtggtttgcatcagcagcctccattgccctctggccatcagttagttgatttcagctgctaagagggacccaccaaacatctggagggcaggtggaaaaggaagtcaggatatttaattccccgctccctgtgtccatgtagaagcagcctcaagctaactgcatccctccatgagtggtcatagctcctgtcaggtgatgctcttcatacagtcatttctgtccctgagttctgtccccatttaagctagagatagtgtgcagagaagagttaacatagcaagcctgactgcttatttttagaaagacctgcttacaaagttggcctttggctgacatctggatccccactatccccagaactgataagagaggaccactgcacttaaacatttgtacaaagtacggtttatgcttaacacctgctttccttgtgggggtcttaaatttgggtaaatgccagatagaggctgctcataggaacagcccccaataaaaaccctgtgcactgagtttctaaggagcttccctgattggcaacacatcacacatattttcataatgcattgctgggggaattaggcccattctatctctactggaagagaattcttggaagcttgtgcttggtttcccctggacttcattgatatgccttttccctttgttgatgaattctgtaacatttcactgtaataaattttagccatgagtaggactatatgatgagtcctgagtcttcctagtgaatcattagacccagggttcagggttggcttgagaaaccctgacataaatagcaaaagagctctgcagttctgtacctgagagtactggaccatctcttttgcccacccttttgaaagtggttcctttattgagctctccccaagttactttttttgagtgtgctttcttttactgaggcttctagtgactgtagatatttcatataaaaatattaattatttgatggattcttttctgtaccttacatttacatatttcttaacaaaaagatgaatggtttaaaagtaaggtaacacagcaacctgtacccttgacatcttatttaaggagaatgtttgattaggttgtgcttctttaaatggatgggggattgtgcatcttgtttaaactagaaaatagtacgtaaactggtggttgattgtccctaaaaatatttagctgttgtttttctcctttatctttgcgtattctggtgaaaaaaaagaaaattcactctcaaaagcagggagactaagaaaaatttacagtgacagaacacaatgttttcatggtatatatttatattatagaaaacatcacttaagtagtgagatgaatgttcttatttcttatgtgcctgataagcaattgtattacatcttaaaaacacctctaacaggtgatggtacattcatatagtatattcaaatcgtttcttgataatatttagattatttaacatccatagctatttatatcaccaaatattattctttcttttacactgtgctctctgaagcaagataaagcattgtgcttaatggaatggaaagcttcctctcaaaaacccaaagattatgctacttaaatttcaagtttcaatggaacttatgtcaacttttaaattaactatgtaaaaaataaatgttgtgcatccttggatggtttctcaaaaaaaaaaaaaaaaaaggcaaagaaagaaatgcttaatgtaaactatggtggttttttacccccaactatatttatgccagctgctttgacctaaaaagtttttttatgcttatagataaaaagctttgttttagagaactcatgaaccctttgtttattaatgtcttggtaaaccacatgtcttcttgataaagcaatcctgaatcagaaagacctctttgctggatatcttacttcagtttgcttttctgtttattgattgctttgctaataaatgctctcttcattgtaatttagctccattccagcaacctccgcccagaggacaagttcaaagttcttctgctatcaatctctcctggagtccacctgattctccaaatgcccactggcttacttacagtttactcagggatggttttgaaatctacacaacagaggatcaatacccatacagtgagtttaagggtttggtaatagaaataaatattctgagaattgacacattagttaagttctttgacattgaggataaatgctgttgtggtttcctctgtctggcacagagtgtttcaaacagagataaaattacaaatttcactagtaatcaaagaaatacaataaaaatgagatgcttattatctgataaatactaatgcttatcacattctcaaagatgaaaaaaaaatgaccccatcaagaattgatgggaatgtggggaagctggaacttttataaactgctgaggtgtctgtgtgagttcattagtacaacttttcatgtacaataatttgttaaaatctatgaaaaaatctttccttttaacataacatttgacttagcaaacttattttaggaagtttatctcaagtgaacagtcattaagtagacacacaagatgtccatacctattctatttgtaacatcaaaatattgaaaatgattcagatgttcaacaatgtttcaggaaattatagtatatggcataacagaatcctggtacattgttaaataaattataggctatgatagcatataaactgataccttagttcacatatcaataaatggaaaatgttcatgacatattgtttaaggcaggggtccccaatccccaggctgtggacaggtactggtctgtgacctgttaggaacaggaccacacagcaggaggtgagcagcaggccggcgacattactgcctgagccctgcctcctgtcagttctgtggcggcatgagattctcataggaacaggaatcctattgcgaactgtgcatgcgagggatctaggttgcacgctccttatgataatctaataataaatataatgcgcttgaatcatgccaaaaccatccctcctcaccttcccatcctgggtccatggaaaaactgttttccatgaaaccagtccctggggccaaaaaagttggggaccactggtttaaagtaaataaagttattaaaataatctgagaattataccattttaatttacaaatactggaagacataataaatagatctagttttctctaattgtaaatattatagaaaatgtatcaaatatttctattataatgaattcaagttttttaattctcaggttaaagaactattaaatctggcagtggagtactaacactcaagcaaatagtgtaatttaatacacacattgctgtttccgcagagatagaacacagcaacataaacttttgaaagagaaaggatataaacaagccatcaagcctatctttgcctttgtaacttttatgaagattttaaaggagcttatagaaatcaaattattagaattcattgactttaaaaaacatttactcagatgttttagatacagtttccctaaagacagaatgaaaaaaataggaatttttacattattccagctctatcttctctgatttttgcttctagccatgtttagctacacactagtttaagaaacctcggaacagcaattccaattcaagtttctattttgttctcttcatttaatacacagttttccaaattctactttaaccatgcttaattagttggagaactgtttaaagctctgtcgaaacactgaaattccataaccttccttaaaatggttaggaggatgccttgttttaacattttaattgactttaaaactcctgcatcgcatagagttttattttgtatgcattatactgggtttcattttgcacctaattcatataactggaatttagtttcttatgtccacccctttctcttggctctacatgtctcttcagtattccaagtcttctttaaagttaatggaaactctgaacttcatgatgcagattgcaaagggaaatgaacatctgtctacatctgccatgttggcaaagtatcctgaaaacctgctactagaatgtttattttcttccaaatatcagcatgatccaggtgtcctgaaacttaaacttttgtgacagagaaagagaggagttataaaaatattgaaaatgattttgaagatgacagtaccactgattatttctgaagttgtgaattagggtcaccctactttccatacagcttaatgcaatagcaaaattaaacttaaaactatcaatgatattattcaagccagaggcatgatttccatagtaacatattgtgatctattttatagaacatcacatgttagtacaacattggctgtttttgacgattgcactaataaggaatccaaataacattttcttacataataaatgtgtattcattcactaatcagacatttatataatcctattaaacaaggtatcatttcctaaaaccatatttttcattaaaaaatgccacttctggcatttcttgacaatcactgtaattaatgatgtgaaaattatctgcatgatggcatttgaacagtaagaacaattggttaacactgtcagaactttgtatcattctaacaatagcctcatgtttattactctatttctagtgcgtggctagcatgtgtaacatgtaaaggaaacactacttatattcagctggatgaacacaaatctttgggttaaataaaggcattaggaattataggtggagaatcattgaacttttcaaagaaaattaatagtgttgtcttccaagcaagtttgatagtttgtttgagacctttatagaattcttttttagaatggaaactttttctagctggcctaatgtactatgggattctctaagacatattttccttcttaggatcatgatatactggtgtaccatctttaaagctttcaaattatttgttattataatagcatgcaaataatgaataattttaaagattgtgaataattaactttaaaaaacaaggtatatctttacgttttatttaaggtagaggtcaagctagcgcttcgagaatcatacataatcagccctaacagtatctctattgtagcccccttctgggttgctcataggtatcttacgtgtcataggaaggaagtgaacagttattggaggaaatagcactcttctgttagtgttgcaggtttagggagtggacagtaactcatactgttttttggtgttgttcctatttgagtttggaatcaaaggagcactagacatagtaggcagatcaaatttaaaaataaaaacgatcttcattactgatgaaagtcagattagagactatatcctttttcctgcaggaagacaaattagaagagagaaaaatcaatgggctgatctgcacataatttgctccctacaccctgactccccagattcacagtcagatgagttgttcctcatttgggatggcatgaatggggagatagcccttaaatgtcactttagagaaatccttccacaggaactagaggatgattatttttacatgtaacaatgacttctatcacctacagatattatcgtagtttaagcttagaattttagacaaccaaatattttaatgagccctgggatttcatttctacccttattcatttccatctttaaaattataatttataatctcatactacatcaagggatcaatgtaacaagtggtaagatgattcagttagctctgagaggaataaatgaagaaatataagatatagagacaggatgagaaaacagaagagaagatgacaggcaactgtttttataaggctcttaatattcttaatgcggtagtttccccttatccatggttttgttttctgcagtttgttactcatggtcaacaatgttccaaaaataggtgagtctacagtacaataagatgttttgagagagagagaaagaccatattcacataactattattggggtatattgttataattgttctattttattttcagttattgttgttaatctcttactctgcctaacataaattaaactttatcatagatatgtatgtataggaaaaagaacagtatatatacacacatatatatgtatgtatatatatgtgtatatgtgtatatatatacatatatgtatgtgtgtgtatatatatatagtttaatactatttgttgttttaggaatccactggagatcttggaatgtatctcctgtggataagaggggactactatattctttcctggaacaatagatcaaatatgtatagaaaaatcattcatgtgtttaataaaattttgttcagtgcttattccagaccagaaactgtatcagtcattagaaatacaaagatgaaaggaatagttctccttactgagtggggagacatataagtaaaccaaagtaacaatagaatatataaatgttgaagcagagtaaacttggggtgttaaggaagcacacggtggcttgggaggtgtaggaaatgtaaccatgcctgtggtggcaatgatgtgatggagaaccactgaaagtttcccagtaaagaaagaatataagctgaattagccagatactgtagttgaggaagcgtgatggtcatgaaataaattttgtattaaaagaaaataaggtatattcagcaatcatgggcagttccatgtagctttggtaagtggtacaatgggggagtgctacaaaccaggagggtatcagccaagatcacaaatcagtgctgagccaaggactgtaaatgtttctctgaaaatgcagaagtctgtagtaacagcaaattttcaaattcagtgttaaagatccgtaccccaaccaaggagagcaactaccttgagataagcactcttttaacctgagtattatttttttgttatggatcattaatggatatcctattcataccctttcaaatgcttttatatctttcacactataaattgccttatatgatattcctacacaaatgcatatttccatcccaattctatctgattctaatttcttattaagtagactgctcttgtataatacattctgatctattaggattatattccacttttcagatgctacaaacattcagcaagtactgtacttcttttaattgtcatcaggttataagtcttccaacttccagtttaagcttatgccagacaatcttttggaatattcagcactgaaatttatttttttcttttaggttttggcttttggcatgctaaattattttccatcgttgttctagccttcagtgatttttcaaattttgttaatgttttcaacaaccttattgtgggataagggtaactttaatctaatctagtaaatatttattgaaataacaatgagccacagctgcacgctctctagaaagtctgaatctcagccctaggggacttttccaaatatgatccttctttgggtgctctgccttagcactaaggatggtgactttcccctgtctcttctattcctatattctttagagttttctgtaccacttagaaagtaaaaccaggcgacctctggtacccatggtacaactgaaaacagccaccagagagagaactgtctcaccttcctcggctctatcagggtcatctctgataagacagtggccctcacctgagtcagtgcccaaggtgccccccacaacaccagcggaggcctcctccactgagcagtcggaccccagagtgctctgtaggagctgtagactgggaagaagggccgggtgtggtggctcatggctgtcatcccaacactttgggaagctgaggtgggcggattgcttgagcccaggggttcaagaccaacctaggcaaaatggtgcaaccctatctctacaaaaaatacaaaaattagccgggcgtggtggtgggcacctgtagtcccagctattctatttgggagactgaggcaggagaatcgcttgaacccgggaggcagaagttgcagtgagccgagattgtgccactgcactccagcctgggtgacaaagtcagaccctgtcttcaaaaaaaaaaaaaaaagaaaaaagactgggaatgcctaggtttacacgatgggttatcactccaaagatttgtgtcttttgtggccaatggcagatccaggaaagaaatgaaagttgccgatggggataggctgggggagagcaatacagatgtgtatgggaaaccccaacccatatatattgtaaatagatggactaggctaaacattgttgctgtttcagtcttctgcaaactcagcttttccacaataaagctctatctcctgtcggaaggaaggaaggaaggaaggaaggaaggaaggaaggaaggaagggagggagggagggagggagggagggagggagggatggatggggggaggggaaggggaaggggaagcacataaatatgctgggaccttcatattgctatagggcacccctgcttaatggaaccctcctcgcatctccaatgcaaacagccccatggcggagcaggcagcagccactctggtatttgtgtgtttcgcagtcctacagtgtgtttcctgtccttagagaacaaggatttccagccatgtgcctaatcacctccactccctatcttattttttaaaaacctctttgtagctgcttctctttgccctcacaatccttcatgcatagaagtcctgcttatctaaaacttctgttgtgtaaattcctcattgctgataacaaatgtctccaaaatttagcagcttaaaacaataaacatttataatttctgtaggtcagaaaataagaaaattttccattcaagatgttggccaggtgacagatttaccccttggtggtagtttactgacccttagtctggtgtgtttagtgtttaacaagcaaacaagttacatagaggaaacatagttacttttctgttttggagaaccgcaaggactttctcttagaccttctaacaaaaggacactatgaaaagcaaaagaagaactaaaacaaacatctaaacattctttattatgaatgatactttcttatactcaataataaaagcaatcaaccggtatttacattatttcaattttaaaaatatgaaatgtatccttaatcaaaagagtagattggtatagtttatgtaattaaataatatgataggaaagcagttagcaatgattcttcaccaacttgtgaaatgtaactttgttttttttttttcttttcatttcaggtattcaatacttcttagacacagacctgttaccatataccaaatattcctattacattgagaccaccaatgtgcatggttcaacaaggagtgtagctgtcacttacaagacaaaaccaggggtcccagagggaaacttgactttaagttatatcattcctattggctcagactctgtgacacttacctggacaacactctcaaatcaatctggtcccatagagaaatatattttgtcctgtgcccctttggctggtggtcagccatgtgtttcctacgaaggtcatgaaacctcagctaccatctggaatctggttccatttgccaagtacgatttttctgtacaggcgtgtactagcgggggctgtttacacagcttgcccattacagtgaccacagcccaggcccctccccaaagactaagtccacctaagatgcagaaaatcagttctacagaacttcatgtagaatggtctccaccagcggaactaaatggtaagaatccaaggctgagattcccctttttggtcaagacatgaatgagaatctattgtaattgtgcaattaggaatttggcagttgtattcctttttataactgcacaatataataattgagaaacagtttctaaagatataagatagtatttgtcctggttagtggaacaagtgtatttcttctaatctaataacaaattccattcaattaaattgccccttaaaaggctaatattatctttgctcttaatgacatctgccataacacaaatgatgtttataatttgaaactcacttatgaaatgcattatatttgactgtgtcacaagttagggcacccacaagcagtacatttttctcttctaagcaagaaaaagatataaaatgatacaaaaaatatgtatataagctaactgactccattaagttaatttttgcattcatgcatttgaacccttggttatataggccagacacacattcacagatttttaatcatttatatcatgtacatattatagcaaaatctttctttagatttgtaaagttatttggtaaaactgggtagagattgactataacatttatgcaaacagggcttatgttaaacaagttaaattaaaacctccaaatttgaaaggatacagactggagctataatgatcaaattccccaaaagaactggccattcttaacagaaattgtgaatatcaattctgaaaaagattgaatttacctatgataaagtgtagttattttttgtctatgtgttatccattttggtttgttttcctcatgagtatgcctttaatagtattttatacattcatctatatagcagtttgttgtcttctatgtacctgtcatctagattactaaactactaaatcactacattttgaatgctaaagaaattgacagtaatctaattagaaagacaatgaatatccagcactctttaactgacctgtccctaccctacccctaaagtaacccctttgtctgatgagttacgtaggttcactatttaatttctctaggaataattataagatatgaactatacatgagaagactgagatctactaaagaaaccacatctgaggaaagtcgagtttttcagagcagtggttggctcagtcctcattcatttgtagaatcggccaatgaaaatgcattaaaacctcctcaaacaatgacaaccatcactggcttggagccatacaccaagtatgagttcagagtcttagctgtgaatatggctggaagtgtgtcttctgcctgggtctcagaaagaacgggagaatcaggtaaagatcaatgttttaaattctacttttaaaacctctgaatgcaaatgtttcctcaaattaaagtcaaagtactgtgaaagtacattttgaaaagcaagaattagaaacttccatagaccaaggaaaattttcatatatatggatttgttacataaacaactcaaggtcataaagtacttgcagcaagttctagggggcaaaagtaaatgctttagttattaattcatggggcgaaaatggcttaactatagttatagtcttctgggaatgtttgtcaaaaatagcatttggtttccactcctgaagtggattggacacatgtctcatcttgctccatatacagcctaatttatgttcaatgaaagagataactgtcaccaattccacaaatttgtctttgtttttatttatctttccaaaataaatagtttagatactagattgtacataatgacagaatcgtggacatcaaaatctataattcacaagtgtgcttgtaagcagttggcatgatgataaggaaggaggacaacatatctaaattttctggattatcttcattaaggcaaaaatttttaatcctccactttattttttatattaaaacacttcaaatttcatgagcctttaagaaaaaaaatacacttttgttatgtgtttaatctgtagatatcaaagaaacccaaaccctgatctaaacttgacctgttaggaatatggaggatgagggtagctttaggttgatgtccaagggaatcatttcatgaataaaatacgcattgtgcttgagcatctcttaatgactaccagccatcttggacaaataatagagccatgatagcacaagtgatgaggcatggcattctggaaggggaaaatcaaggtcagaaatgaaaagtaatgggtgaaactgcaatactggtccctcgtaatcttatgggtcactagctaatgaaagtgcaatgagttcctttgataatacacctttggttagcacatttaaaatccctgtaaagagctcaggagtggcaggggggaaagggaaatgcatgtgtatgtaacctgaacatttcaagaaaaatttaacaaaaactttgagacattcattggggttatttagaatgctttaggtttacctctttctgaagaataatattcagccagctgcattggattggctcaatgacatatttccctacatgggaaatccagtacatcaccatgcatttttctgaactttttgaactgagatgttctatttttgtgacgttttttagatactcgtaagacttataatttcctatctatccactttcctatctttatgaacatgagcaaattcctatgagatttttattttgcaagtagaaagtagctggtaatatgaagatggagaatatactttcagataacattttaaaaagtgaataccttttacatataccagcatattcttggactttttcaaagcagaatattttaaaaggtaaaggtatttcagaaactaaatgaatgtgtgaattaaatttaaaaatatatagggacgacattcattgttttgatgttattgttattgttctcattgatagcacctgtattcatgatccctccttcagtctttcccctctcttcgtactctctcaatatctcctgggagaagccagcagataatgttacaagaggaaaagttgtggggtatgacatcaatatgctttctgaacaatcacctcaacagtctattcccatggcgttttcacaggtattgttatttttaactaatgtcctttcagaattggcttagggcttcatttggacattttttgagtttgcagaattctgtgacagaattctccctctatattgattaaacagggcattttttcttaatataatattatgtgtacaagcctccctctttgtatgtcacttgtatttttccagtataatcatatattgaaactaagttggtataatttatttcataagacttgttttttttccatttatcatgtatccttaaatattttacatgaagttgactttcattaactgtgtactatcatgttatttggacacacaataattatttaaccagtccacactcagttgatattgtattgtattaattcttttggaaatataaataacattgataaaacttcttatatgtacatttcatatacatttctacttcaaaaatctgaagaattgaatttatcacagcttataacaaaatgaattatgaatatgttcaaagttttgaatatacagtcatatattgccttctagtaattcatcccccagctagcagtagtgagaataattatcatagctaaaagttactgaggctttactgtgtacgtgaactaattcatctgatacatacagcaatcctagaggataggaggctcttgttctctccagtttacagttgtggctgatatacctctctgcccattttaccagcatccaggtggccaatagcagaagctgatggaaggatgtcaaccgaacaagttcttctgtgtatttggctgttcagtgcctcctctgagagagatgctcttctctgggcattagcataagataaaaagatctttacactttatacctactcccatagatctagccacatttttctttccatgaattcctagttcctgatccttccatctttttttttcatgcccttggccaatatttccaagccactgccatattgtccaggtacattttaccttgagacacgtctctttccacacaacatgggtgaccaggtgaactgcctgaagttctgcccactaagaggatttcttcgctctgctgtttcacagggtcatctctgacaagggttttagagcaacagctaccatttagacttgcagccacataccaagacatcctatctgtaaactaaattctgctttttttccacattctttcagctcttaagggacctcccatgggtcataggtatgagctgaggttgagccaccagtataagaatggtggatgtcatgggggcctgaaccacctgcttgcacaatgtattacggcttttggctctgcttatacccaatctcagacatccacttccattttatgatgaatttctgttgggcccttctaacctcaagacttggctgagacaattccaagattataaaaaagtagctctagctgcatggctatttggtgttccatgaccagatgttctgtttttactgaagcctgaaagcatgctagggccatttagcaaatggtatatagtttccattacatgttatgcctttgttccaagctcttggggtctatctgccctgtgattctctttctatgtgtgccttgcaacattttttcccacaatgcttacctctagtgctgtaaaaattactacatgttatgtcccaagtggctcatctgcctgtaccacaggctggacctggtgcagagccctttccgcctctgggatacactcaaaactggcagcattccatattactcagtaaatttctcagaacagtattctcaaatgtggaatatgctcccttcagaatgtgaagaggtcaactagacattttgtttccttcttagtggtggtagaagcaaggtgcaataatttgtcctttattttggaggggatatcctagcatgtctcaggccacttgaactcctaaaaacttcactgatatggtagattccttaatcttcataatattgctgtctcactttctagaacacatatgtcttacctctgcatacctaccatttcttgtttgtctgattcatttaatatgatgctatcgatataaagaatactgtcaaggtggcatttatagtttgtcttaaattggtgattaatcaccctcagatttcctttgtctttcttcagtgcattgatggcgaccagcaagatccatgcattgtccttataattactagtttccccagagtagtccttgtaattactaattccaccaaaccagtgaattaccttctactggtaactcatcgcagttcaccactaatggaagtttaagcattgcaccactagggcatgctgtggactgttagtactctacctgctgtctatgatgagatcattgtaaaccagcaagtggatgatggagctccaaaatatcattttagagtctccttcctagggccagtcctgttacgactatcttagggcaaattcccccggaagcagactcttggtagaggactgagtacaggaggtttattgggggaactctttcagaaacaacaaatgtgaagtgataaagtatgtaggattgagcagcaaagaagctgaactgtgatgcaatagtggaagcagcctcagcggattccgtgggtagttctggagctgaaatgaccctcttagcttatctcaaattaagctaggaagtcagacctttgtaccctagagtatttgtgtcctcgggctggtgtaacaaattaacataaactgagtgtcttaaaacaacggaaatttaggtgttagtacagccaggtcccccacaggctctaggagacaattcttctcttctacctacctgtggctcctggtgttccttggcttgtggcaacataactctaatatctgctgcctctgtcttcacaagtcctactctgtgtctctgtctcctctgggtctgtgtgtccgtctcatttctcccataaaaataccagtcattggattttaagctaacctgaaatccaggatgacaactaattaattacatctgcaaagaccttatttccaaacaaggtcttattctgaatttttgggagacactatacaatccactactaataggtttgccatttttttctaagcctttttaggagaccagaacccatgtacaacacacaattttattttctatactgatgaaaaagaagagccaataaataatttatgattacttatttttcattaatctgtctacgtgttcactcatttgcaattatctcatgatgaatacacaactggcataatatatatattttgacttaaacaggttagtctaccgatctggtataccatgggatttaaggtaaagttagttgtaactttcatgtggtctttgccatgttgtatctcatttatactcaatgttttattttgttgtttttactattctctggctttataaactattctttctttgtaaaacacagttttgatttatctattacttatattatagtagttgttgttctaagaaaaaaataaggtgagaaatattatttataaaatacagccttagaagtcaacctgtttgttcatattccacatctcccaattattagctgtatcacacgtctctctgcttctggttttattcatctgtgaaatgggaaaaccatttttgctcacctacctgcttaaagagcctgataaatattgacacattattattagtgattattattaatggtgtggaactacattatactttataaactagctatcatttaatggggcaggaaaataaatatttttattattgttgttgttatttaaaaggctgttccttatggctgaactggaataaggacatagatatatcaccttattctcttttttatttttatttctttgagacagagtctcgctctgtcacccaggcttgagtgcagtggcgcaatctcagttcactgcaatcttctcttcctgggttcaagcaattcttgtgcttcagccttccaagtagctgggactacaggtgtgtgccactacacctgactaattttttttttaatttttatttttagtagagacagggttttgccatctttgccaggttggtcttgaacccctagcctcaagtgatccacccgcctcggtctcccaaaatactgggattacaggcatgagccactgcactgggcctaccttattctcttttgaactctctctcctgtgcaaatattctctgttcaaggaaatgaaatcaaaagtagcagaacaaagtccaattttttaccttctcaatgattaaatttgtatctgaactgacctgagtatgtcttgttataatctttgtaaataaatagccaaaattcccagggaaaatctactataaaaataactagtaagaaacctttgcctaagaatgagacaggggggatacgtaaaagtggtgatgatgtaggattcattgtgggggatcaagctgctgtagaatttttcctacccctttgaagacttatttcatgaaaaactttcaattagatagattttataagacttataaattgactctatgtacatgataaagacaaagtctatccaagtgataattttatgctgcaagttctggggccaataatgtatttttaaaataatgtaatttataataatcatctgtaaagaaggaaaagccttttcaaaataaatattagtgtagatttcttctttcttattttatttcatcgtgggttcttgctacaaagaatattttgcttaaaaaatagttgtacttcctaaattaaataagaaatagcttcatgtactttatcctaaaaacaataccattttctaaaaatttacattgaaatctaccaggattattctaaaagggatgaatattacagcaatattcataagtttaactcagttcaaggtttattttacttagaaaattttaaatcacatttcacagaaaagtttgtatcttcattatatcaataatgattttaaaattagaaaaataaagaattacttggtatttgatgtttttcttatttcaaaatgtaattgcaaggaaatggttttaaagttttaaatttaaattattcctagagttttagaatctttaaaaacacctttatttctgaatgttattgaaacactgtattctacattccaatctcactgctttttagaacaactcatgtaacttacgaaattttaaagtcaacacctaggcaaatattccaaatgaattttattttacccctaaagagaaagtctctagaaaactactccaaatgttactgaactttacatttatctgtatttatatttatggaagattattttatatgactatgtatcagtagccctaagaaaattagttttgtactcatagttactgtcatactctctgttttaatgacttttattttctgaatataatttctagtggcctttgtacctacaacctaaacaaatttacatggttgcttttgatcacttcaaattataatgacagaaccaactctcaatgttaattgtttaataatttatttatggactgtgagtttcctgtcagtcttctttgctcaaatctgctattttcatttgaaattatatgataaagataatatttcaaataacgtaactgtttgatctaatctttatatgtttgtttatataagaaagatgattgagaattgacttaacgtggatgctcagtaatatgcttaatgtttaattttttcccctttttcttctgtgactttttttcataaagaaaatgatagtatcgatttaacatagcaacggcatttctttctgtcctagcaccatcaaatagcttgggtattactgctctgggttacttttggccaagccccatggctttgtttggactttatcatgataacaatgacaatgtcaccgtctttatctctaccattggtgacaataaccataccaccatgctgctttatgaggcaataacttggttttctcatttatccactcaggaactggattattacctcataaaacagtgtgattgtacaataatcaattaaatcctggcttgtcgagactcttcagaaaaaaaaaaaaaaacccttttcctaatggtggttggcaataattccctctgtctgaattcatggaactttgactgccaaggttatattttcacactgattacctattatctttctttctttctttctttcttttttgccttgaagctgttgcacactgctaaatcccaagaactatcttacactgtagaaggactgaaaccttataggatatatgagtttactattactctctgcaattcagttggttgtgtgaccagtgcttcgggagcaggacaaactttagcagcaggtaagcaagttttaatggatatgaaaaatctgttgcctatcaagaaaaaaaacttataatattcaacaccttctctacttgagactttatatttgtcttctcctccctcactaactctgattgcttcttacctcaacagttttaaacaacaacaaccaaaacgtaacttaaagaggtacctaggagctacgagttacagctgtgtcataataagaaatataattagtggtagagtgactccactctacaactagaaatatatagaatatacaactagaaacatatacaaatatatagaactagaaatacatagaaatgtaattagttgtagcgtgactccagggcttaactaccaacctgtgtcctagcagtgtcctgacaattgtgagaaacaatcaggaagcttcttatgaggacgttaggatacctcttccctcagtccagacattttttgtaggcttggctctactcactcctgatccatgggaacatctagaaattactgtgtggcctggtgttatatttggctttcatgaaataggtaaatgtttatctattgttttattaagaagaagcttttaagttaataaaatttaaataaaagaattgttattaagtataatctgagtagaaatggtttgtataatttgtgcttgcttcattcaggactaactggattcatacaaacctgattacatgtattagtaagacttataaaacccaattatttagcattaatatattttcaaatcagtgtttttctgattctagataaaagcttagtttcctggttatctttaaagaaatgtccatgtgtaaggaggttaagacactctagatgaattacagatattacgaaaattcatgtttacctgtaaaaacatttcctagacctcctccccaaatcccttcatcctattattaataggtccaattatgtagggttttttttctggttctggaaaaaattgcttagctcaaatgatctcatccaagtaatttatttttttcaaaattttcattaatgcaaacaactctgaaattctaagaaattatggtttactaaatttataactgaacactttgtatttttatgtattttatagatgtgcatttcagatgcatgaatacattgatggagtacctagcttgtacaaaacactcttctcctataaaactatctgtttttgtatactgtattattaaaggtttactgaatgctgaatatggacagcagaggaggactctatctcctttaaatgatacaatttcagactagaagacaaaaattaaaataagaatcagtcttacaagttggagaaagtaaaaatggagacaacggagggtgaagactgggtgtgttatagtaggggacatagggatcccaagcacgtggccatgcaaaactggaatcacatcctctcagggttgcaaaacatgtaaaaataatctagtgttactatatagccagtatcaatatattctttgtaatattcccccaagtgttcatctaacccatgtctgataccttcagtgttacagaaactactacgtctcagacaaagctataccatctttagatacctcttttagaatgtgatttcttagattggtcaaaaatatctcctagtaacttctactcaacattcttattctacttccttgggggctgtcgttaacctaatttatcatccttccaataacattttcaataacattatatccacccaagtcttttctcctttaggctgcatatcatggtggttcccatctgaacctcatatgcaatagtgtctagagctgttattagtataattcttgtagatgagatctagtctgccttttcatagatataagcaaactaaagaacctgaagagagacatgcccgtccctagaaactagctggatcatggagatgggaatagaagagcaggaaacatgtctacagaatagaatctgcctgccctatgcattagtggtaacatctgtgctaatagtatcctcattggttgcagtggcaaaatcctgttgcgtaaaagatgatgtacctgggtgctctgtgcagctctcattttagttactggtgaggcgattaaaacgactcctgtccactggcaggattgtgaagtaaaactaactagtcagagccctctgaatcctctctctattttttttatccttgaaaaatagaactggaaacttatattcgctaaaagtcatgtgacgtgaaagttagttgacttacaaaaataagagtttattcatatatgtgaggggaaaaaaatggttagccaaaatgccagggtttcaatccgggctctgccattgactagctgtgtgaccttatataaattatctaacctctgtgccttagttttccaatttataaataagcataacttatttgtagggttctgatgaggattagaattagttaatacatgtaaaatatttaaagcagtgcccatcacagttcattctcaataaaaatttattgtcatgatttttatcataatattatagaagacttttgttagtcacagtataaatgttatggaatttctaatgttatcaaaatcaaggagagtttattttacaactttgattttctaacattattataaaatataaaatggagagttctaaaactaaggattgtattgtgaaaataaaacttagaaaggcttaaaatctgaaagcattatttattatttctgtaagaagtatgtcattcagaattattatgcacatttcaaaactttgctcaaaaacagcaaatttcacatttgttggttgcaatatagagttaataatgtgccataaatgtattattactacattttattgtgaatgctcaattcagaaccatctcttgagggcttactatttaaagcactgtggaggattctaagataattatactcagcatttgggttaaggagttgagatccaacaggtaggattaacaccatggcgacatgtgctaagggctgtgagaaaggtgaaaaaaatgctatgggaaggtagaaaatgagataaatgattttgatttgggagactgagtagatacctcattaaatgctatttcagataaactataaaagaatggtaaagactttcgcagatatttactgagcacatacaatgtgctagtttctgttttaggggctggcactgttccaagtactgatgtaatgaaagcagagatttatgaagacttccctggtggtagagtacacaatagattagaagagggagtgtaataagtgtctggtagacttttttaaaaaggcaataagagagtaaatcagacgagtagaagtgaagattgaaagaagggaatggagtgacttcaaggaagacagacctggaagttaagcagtgggaaggatggacaatgatagcaaatattgcagcccatggtggtgccattaaataaaaggggaaagatgaacaaagaacagatgggagaaataaactcgtgagtttatttgatcatttgatagaaacacatccatgccaattataaccatccaggagcagaaattgcaaatctggggcttaaaaatgatgcagattttgtattcatctgcatatagatgggagctaatgctataggttataatcaattagtgaaagcagagaaaatgcaaaatggaagcccaaagaaaacaccttagtgaatattctatctgggaagaaagaagaaaggaagagtgaagtgaacagaggtatggtcagaattaggaaaagaactgagaggaagcagtatcagaaaagtcaagggaagagagaattctagaaggagaatattgtctgcagtgtcatatggtatagggaaagcaagagaaatgtgacctaaaatggatgcgaggtcactggtgactctctggggattaccctaattagcatggttgaagcagaagctggaacatgaaggattgagcagcggcaggaggagatatagtggtaaatttcaaatgtgtttttttttttttattctttgctaaaatttttcttctacccaattttcattcttcaaaaaattgtattaccttttgtttccatataaaatcctttcttttctaaagaaaaatttattttagtgtttgtttttttctggaaaaaatgtttattttctaattccttaatatattttgttagaactatctgattcttcacctgcccagcagaaaaagaaagtctcttatatgacaaaagtatggaaaaataatttttacttacagttgggtttattataaaatacatcatttttagggttgttcagatcagtgaaaataaacttatttgcttttatttgaataccaggaaaaaattataaatccatcattctttttgcctccttccttattcagtagatgaatgtgtatttctaaatgtttttccaaaacaaaacatctgaatagaaagtatagacattaaatcatagaaatacactgcagacctataataaagccagttctttagaatggtcaacaattttgctataggagagtaataaaagttgacttgcaactttactgttcatcctgctctgttttttctactattaacattgcaatttggagagtatatattattccaatgaactccaatggatttgtgggaaatttaactcttatgtctaatagctcatatgagctcattatcagacatcaatggaaacgagtgaccattcaaaaattttgaaaaagagcaccacaaattagaagtagtaattagccttttggaagcatttgaatcatgaaaagatatgttgcccccttaaatctcggtctcaaaaatcagaaagatacttgtgaagatttatcttgctgtttcattaaaaagcttgagaattataattggctctctcttgttttaaacattttttcaattaaatatatgattagaatgggtacatttcatccagagtattgcactgctgcttctttagtttcaatgcctgtgacaaagtctgagaactgatttgagagaggtgttctctcaggagcagctgcatctctctccattgcaaaatcttcaagcagtgttattaatggctttggagttgcttctgggtgtatgaaggtaatgagttgatgaactgggccctcttaaaatccttgttacacttttctttaagattctccttttaatccgagaaatttgtgcatttccacccattgcaaattgagtttagtttaaacccttcttatgagaaattacttttggagatccattcctgaagggacaatgtgatatttcccttgcctgtcataaattgacctccatactacaagcttagaagtgcccatctcgcataaaacaagtaattggtgtgcattaaattttctttctgaatgcaaagtaaaatgtataggctgtttgctgctgggttgaaaacacacattgttttgcattcgggtacataagtcttttccttgtgaataggagccagagtgattaaacaagcactcttaatatgttaatttataattttaattacaacaatcttgtatatatagtcattagtgaatactaatataaatatttttctacctttttattcataatgcataaaccaatcacccagttacttctctgaggttgcctgtttttgtttcataatacaatctttgttcttagttatgaatgcattttgttcattcctgtcttcaataatccctcattaagctagtcactttctgctccatgctaaaaaggaaaaattatcatgcaaatgtggcatgccatattaaaaagcacattaccaaacacttttgttgctgtccttcaattagtttcccttctttgaatttaattccatttgttgttaaactactgacttgatgtatggactcatgaatctgaggctgctgccaagaaagtggggaaaaaaaatcaaagcctcttcgaagagctgcagaggcgagctgaaatgaatttgcttcacctttgacaagaacacttgaacagcattggaatcctctgatgattcaacttggctaattatccaattatttatttcaagaataaaggcaccattttacaattaaggaagtgtaaagtagtctgagaaatttggtaatgacagatgacttaagtaacttctaagataaacagtatctgtgcaaaacttgtcccaccaattgttttcaggcagcagttggtgtgtcttagcatcagtgaaatcctgagtacactgaaggttttttgtttgtttgttttgctctttcaacagaaattattttacacttgtaaccaacatgtcaaatttccatggctcttaagcaatgtttaagttatatttctcttgattaaaagctttcggttcaaagcaatactttttaattgcctaatgatataagtcagttcttaggaaagaaccgcacatttaggagttcatttgcaatataactgaaaaattcattgcatggcagtaaaacaatttactgttaattacaaggagaagaatttgctgtagcatgctcgcagattgccatgaatcatgcagcactcctagagatttataacagatgtgtaaatgggatgaattagcagggtttaataacagagacacaaatcatgcagacttcaaggagctttaattgatatactagaatgtgacgggcatgaatcactcagccattcaacagcactgtaacatatggtcagctcaatatgccgcatcttaaatcggttggtgagtcgtaggttgtcccatatggtggaagcaatacatttttcatgattaaaaaaaagaatccattttttaaagaaatatgattgcaaagcatgttattgaacagtcttctgaatgccaaactgctttttttaaatgcttttttttttctttaacatggcagcttctcaaaataaataggggctactccttgtaataccagatcgctggaggcattataagaaccaaatcggtgcttgttggcacactcgatccacagcaagcctatagaaaagcgcagctgatgattgctgtgattgtcagggaaatccttcaggctggggcaaaacaaacaaatgaaaggatgatgtcactttcagagaagttcaggaatgcccagctttgtaaattgaagaaaatgagttggatgagagatccctgcttagcagggtaagaaagtggctgtgataaataataccatgacccctaaggtaacaattggatgtaacattttatactaacttcttaattaaatgctcagtcctacaggggcatgtgaaaagaagcactggctggtcatcacatagatggtagcaccaattccaagtcattcttgaagaattatttcagtatctgcaaacaggtaccctggttgaagactggtaactggtagtgtgcaaacatgtttttattggaactgggatctggcagcttttggaaaagcttttgctgcattagtaaatctgacagacttgaaaaaggaatattgcagccttagaactgtggctgccagaatttaatgtcaacaattaaaatttattttgatccttacctagtgtttattactgtttgtatacacaacagaccttactaatacagagatgcactattagatggaattaccatctgttcagagtgaaatgctggcatctgtcttagatgctaaaactaaaatgatattatttctaacaaaacaaaattaactgctttttactcaccaactttaatttgtagtgtgtagttgtatccaaggaaaaggcttgattttgaactatgtgatgacctctgtggccaggtctatatttagatatgcgactttatcaggggctctactggcctttttggcatatgaaaatggcatgtagaaatcacactttcaatacacaattatagcttcataatatactatgtatcctataagtcattaaaacaacacaaccaagctatgtaaaaattgactgaatcagagagactctactatgcaaaatattttgacagatacgccctaaaaaactgcaaggaaagaaattaaataggcaaaaaatcatctgaacaaagttgctataggtcccacagtgacatctttaggaaaatacaaactgtatctttcttctctgttagactattttaaattttctcccacatggacatatataaaaaatttacattcagtgccccctccttttaatttaaagcctaagtatcctattaaaataggtctttagcttttggaagttagagaatttggaggatcaaggacaatggtagtttccatactgatgttagatcagtgacgctactttctgagaagccagacttctattctatatatcacaaaataataaattgtgtcacaccagcatttaatgcatgtacacagtgcattaactgtaactgtagtacatttatttgtgctgcaggagacttgaaaatgatgaagaaatcgatactttgctgtcagagaagcaagtgttacgatgcatttaagtagttaattgcataagccccataaaagcttcaagtttgggtagcaaggatgccataattacagtctgagcaactaccttttattagtggtggactttagggaatggtggttgctgtcatcattgctgctatatgtgcagtttagaaataatggatcctcttctctcttcatgtgtaggatggtagttttgtgcaaattattgtgatcgccagaacaataactggttaaggtagtgtttgttcaccatgttcactgaacttctctaaaagcagggttttctttatgtcacagaacacatagacaaatcatatttgtatgccatgctaaggtaaaggaacaaggtggctgagagctgaaggggataaaccagaggggctcctgctggcttcccaggagcaaaggggatcaggatgtctggtacccattcgtggcttatgaacttagaagtactgttttaaattattcaaccaaagaattttgaaactggaagaggtcctagacataatcaagcctgtcactctaacaattgaagtaaccgaagaatagagagacctaataatggattaaccaatgttccataatcagggtcttaaagagccaatctagagcctacattttctcctttccagatcttctagtaatatcctctcctgaaggtgacttgtcaacaaagaagaaagtggcaaaatatattttattctttcttccctggtcagataatagacagtcaacaagatgatgctgagtcacccctgagagtttcgggggaaaacttttcctctttaagacactgattggtgagcagctgattctgcagcagtctctctgcaacagagaaatcagggctcatgacctggacttcttgtttgcgtcctggtccagtgcccttttgcaagtgttctggcctagcagtgtttggcaaattgtatttcctggcatagttttgcatttctgcgaaaaagtcaaaatcatattctattgacagggtgcttattaagaatgtcttatgtagtctgctccccacccacccctgaaacatagaaaaattgtttattcttaaattcttgtcatcatcatagaaagctgatgatgctttaagatattgacacagccatacagtcttcataggcaaaaaatgaacagattccttaaaaacaaatgaacagattccattttaaagaccagtacctcagaagagctttgttcagcttttagttcttatcctatggtgctcaaaatgctacactacataaattttgcaagtctaaatgtattcatttggatatactactaattatgttataaagtaataaatgctgcataaagaatgcatattataacattttataaaaatatctatacatcgaatagatagacaagaaattagattacccctattaaaaaatacaagtgctattttaaaagtacaagaattttgtacttttattcaaatagacattttattcttagaaatgatggataatgaacattcattttaaactttgtatattatccttagaaataatgaatattgaagattcgttttaaactttacatttacaagaattttctgggtaaatacagatagattttgaatatagatgaattgtattccttaatcatacataatttgaaagatttgttcttgtaatgatagcaccttatatttgtatagaaacttgttttctaaaacataaagcaaatatgtatattgttgtagaagcaattgttgtcaatgtatgtcactgaaaatgtatcctcatgttgcagatgggaaagtgggagcagatataaagggatttttctaagatcacacagatttagacattaaaaagtgaaatataatttttaaaagtctaccaaatccctttcattattcagtgttgtctcttaacgaactgttttgtaaattaacaaatctttaaaagtcatatctacttttacctatagttccttttccttgaaaatctgacgaataattcatcattaccccaatctcttggtgattctatgtgcatgtatgtgtgtgtgtttaatggttcagaagtatctatttttcttcttattctacttgtgtgtatgtgagaccagtctagtttaattgattgacaatttcacttaattcccccttccagccttagaagaactctgaaaagaataactcagtaggatgttcaccctttcaaacaggcttagttgactcctccatgtgaaactgtaaaacacacctactggaatgttttttgttttgtttttcttttaagcaagagaataaaaaatgtactctagttctattcattctcaggaattgacttctaaaggacagtcccattgctagatggaataattcctctgggaatcaagaagtgctctactacttaaagtttaaatggtaaacattaactttaatggactctcaagaatttccctattgattagaatcactttgccaaattaaaaaaaaagtgtgctctaattttcaataattattacacaaaaacgacagagttgccagaattccttttgtttagttttgtttcctattactcttaatctatattcctgtttaagacgtaatttttggattatgctactgatgggggaaggaatttgatttctgtggtggtgctgagcttcaacattatctccattgagttgagtggttggagtaaagtagagatgtatcaactttcaaacaaatgggacctggagaaaggctgctttcaaacagcaatgaaattcttcagcttttaagaagcataggaggcatattcatacttcttctcaacatttagttaaaatggaaatcctatcctcaacacaccaaatatgtataatttgtgatgctctgtctacatctttggtgtccagtatggtagtcatgaatcatatgtggctatttaaattcaaaatacagttaattaaaattaagaaatttgacattcagtttctcattctcactagctacatttcaagtgctcaatagtcttattataaggctagtggttaccgtattaaacattacagtcctagaacatttccttcattggagaaagttctattggacagtactggtaaagtagtttttggctattggatattactaggttagtagtttatgaaactaaaaagttcaggtttctgtgtcccaaaaccctagggaatctagcaaatttcaatttaaacattatgtaattggttctccattgcttccctgagcccaggactaaaaaatctttggcagctttcctttcctagttgagattatagccaagaatggcctgctaaaatcttaatacaaatatgtaactctaaactctgaagagagactctgggtgaagaaatttctgaatggcttagccttttattttgttttggattattttgaagtgagatcataacttgtagaatgaaatctttgagaacctaccatttaactgatttttagcagaaaaaaatgctaagagaaattatgcatataattcacagattcatacatatataaaaataaaatatcacatgggctgcagtggcagaaaataaccagaattgttaattatccttctaacttgatgaactttttgctcagtgccttttcttttttactaaaagttaaaatagaaccaaaatgaattgtttctttttgaaaagctggccgaaggtctaaaaagtaacaaatactaattgttctaagctgctttacggtgaatttcctttcatggtttaagggcttcaattcttatatccacatcattttgatttatatttattgaaacaggcaatgactttgcgtctgtgtatggctgtgttaacacaggtgtaaattgaaagtccacagatgtagtttgggcccttaataaataggctcggtgattatgacatttgttcctttctccacattcacctctcaaatccagcagacatacttaaagggggaataaatctcagctcacaaactcaactgtttaagggaaaaaaaaatcaaaccaaaacaaaccttcattttcaataaatcagctgttaatctgaatgagcaagttgtagggaaaaccttaatctccgtgactcctagggtttcccaggaaccttcaaagaattgccagtgtcccaccacctgaaaggatggcaaggtcccagtgtatgcaagggcatgaggtcactactgctccaaggctaagcccactgctggtggtggggtcacttcagggccagggtgctctctaggaccaagaggctgaccaaagttagttgcctggaccgttgtgtgtaaactgctgaactcacaggcttgttattttgtgctgatgctctgtttaacattcagagtgctattgcttgtttgctttcatttagatcagtttttaagctttaaaaatagaaaatagcgtataaaaggagcttttttgaccaaagaagatatacagatggcaaatacacatatgaaaaatgttctatatcatatgtcataaagggaaatgcaaattaaaataagataccactacacacccattagaatggccaaaatctggaacactgacaacaccaaatgctgatgaggctgtacagtagaaggaatgctcattcattgccagtgggaatgcaaaatggtacagccactttggaagacagtttggcagtgtcttgaaaaccaaacatgctcttaccatatgatacagcaattgcacttcttggtatttactcaacggagttaaaaacacaaaaccctgatatataattagatgtacacatatatatgcacatcatagcagctttattcacaattgccaaaacttggaaacaaccaggatatttcatcagtagatgaatgaataaataaactgtgataaactatgctacatccagacaagggaatattatttagcattaaatgagctagcaaatgatgaaaagacatgaaggaaacttaaatgcatattactcagtgaaaggtcagtctacaaaggctacatgctttatgattccaactatatgactttctggaaaaggcaaaactacggagatgagtagttacctggggttggggggaaggagagatgaataggcagggcacagaggatgttttgggtagggaaaattttctgtgtaatagcataatgatggatgcatgccatcatacatttgtccaaacccagagaaggtaaacaccacgtgtgagccccaatggaaactatgtactttgaatgaaaatgatgtgtcaatgcagatttatctactgtagcaaatgaaccatttgggtgccggatgttgatattggaagagactgtgcatgggtggggagatatggtagaactctgtaccttcttctcaatttttctatgaacataaaacttctcttaaaaattaagtctactgggcgtagtggcacctgtctgtagtcccagctacttgggaggctgagacaggaagattgcttgagcccaggagttccaggctgtagtgagctatcattatgcctgtgcatagccactgcactccagcctgggcaacaatgtgagactccatctctaaaaaaaaaaataaataaaggttacccctggcacattgcctatggtgtagccgtgctccacaggagcaatcaaaaacaaaaataatgaaagtctttttaaaaatgactttctgatgtatttttacacaagcacaaagttttggcaaactcgtgttaatattccttcattacccattggttggcacggattatgctttgcctgtgtaaattacagcacggagttgatgcctctttaaggcaaggggctctgccctatgggtttagtgctagtcattggctgtaggtttcactgcgggatcctgtggctcctgggtgaggcagctcttactcagccaagggaagttctacgcagaagggggcagccatgagccatcagaaaccaacgggcacagaaactgggccattggggtacctgcttggtagagggactgtggttggggcaccacccagagtacagcagctactataatatataagatctattatttagctaaaaagaatagagaagttattttcaagaaaaaatttaatttgaaagttttgtgtgtagtatattggccatttaaattttgtttcactgcatttaagataaactctatattgtgttttcagttcctagagccatacagatacttgaaaccacaactgatttgatttgaagtgtgatatatacaaatacatatatacgtatatgtgaatatgtgtgtctagagacagaaaccaaattcttgaatataacaggtgttttctaatatttagcaccagcacaactgaggccacctctggttaaaggaatcaacagcacaacaatccatcttaggtggtttccacctgaagaactgaatggaccctctcctatatatcagctggaaaggagagagtcatctctaccagctctgatgaccacgatgatgaaaggaatccgtttcataggaaatgggtattgtaaatttcccagctccactcacccagtcaatacagacttcactggtaagtgtgtttgacattgctttatttaggagacacgaagctccaaaatgttttctatattttcatatccctttacaatgaatttttattatacctacttagagaaatactaattcagccctttgatagcttttgcctgattgtttcagcatgtccatctttttagaattctggggaaaaaagtcaggtaagtgaaggaaaggaaaaataaaagatgaagatgaagaagcagccttattggatcaaagtatgtgctttgtatttgtctttttgtgaagtatgtgccaggacatgtttcttgaaatattattcactgtgttctctgagcaaatgagtttgcaaaatgccctcatgctattggagattctcagtatgcaccccgttactgaaactccaaaaagcattgtaagaaagctattcaactttgcttagctaatcatgcctaacagatatttgatgtaatgttttctttttctttctcttgctgtttccttcttctttttttcactgtgacaacttaatatctcatgttctatgaagaacattgtggggaaaactaatcccagggaaaagataacttctctaagccaggactatggtaaagcaagtgaggctcttgtttcggtcacaaaatttaaaggcactaaaaaactcagtgttaatgtaaattttaatgcaatatttttaaaaatgaaaatcaatgtgaaagcactataaaaatattatcaaaagcttaaataaagacagattgaactctgtaccagcacaatcctgcctcactggccttaccctcctcctggccttactagtaccgcaatattttggaagtcccatgacctctgtgacttacagcttctaatagcatgatttcaatatagctgtaaaaaaactctacttatggtacaccatttttccaatttttaaaaaaatttacaaagtataagatatatattattatgtaaactcataaagatgttcatttaatcatccatgagaaagtcattttggagcaaatagctagtctttaaaatattgcatatgtgaagacaatgaaatggaattcgagctataaaaatttgtattgttttatttttacttaaaatagtaaatagtttgcttttcattgagactggctgctgatgcaccttggtaatgaatcatgattatattctaactgagatatattgagattaatgcatgattaactactctctcagtacatcaaaatcattgcagagtattagaaattgaaccattgagctaaaaatgctcaacttctgctttatattcttaaaatggcaaaaaagaaaagaaaaaaaaggtaaggaaaaggaatacatgaataatagtaaaactcttttctcaaatgaaaatggaaactacctccctgatccaatatttggcttgagatgtgtttcttccaagaaatagcatccgtttccattcagctgggcatagctgctgcaaggatgtcagcttggatttgcaggctagccagcagacagatttttgatgggatcacctactgttgttgcagtgaaagatagaatggcccgtccaccgttaataaatttggtcatcctcgctatctcccttgctggccttatactctgaggtgcaagggctaggggcagatgcagtgtctgggaagttttccaaattcctctttaaaaaagttaggctgtaaacactggcctcactaagcaggatccttctgtctataacaaagcctccagctgcacagaaaatatgcttggagtacacaccatttgaaggacaaggcagggagatcacaattttggcttgaactactccctggagctttggtgattcctggagaatgagaagttcttctgtgttcaggcatgttctgggacattgctgatgccctttttagtggtagcttggctttacttttaagacccctttaacttttaatataaccatgtatatactaagttattggtttgatcctttggctgacttgccaggtttggctgaatgattttattgagttgtaccgaagcctaactaaatgtacccaattaatgagctaggacaggttttcaaaaccaactcaataactttctgtaaacttgcatctttcctaaatagagaggtaagcatataattagcatcttacattattcttactgatatattatcctatttaatccctctgcaaccctataaagtagctctttttaccctcgtagtacaggaggaaaagaggctccagtgagtgacttgcccattgtgccacagctattgaatttcagggtggaaacgtgaattggagccttccaaatttaaaggcaaggtctctgctacagggtggaaaggaacttttgtagactgttctttggaagtgatagaataggaagtatacaaaagtaagaaagagggataggaggtgaaataattatcacccaaatattccttatctgacactgctaaactttttggatttgtctttcagttagtttcagctcacaaacagcaagtagtgttggcattatttattcatttatttgtatccccaaagacatgtaggcatcaggtttttttttaatagcaattaaacccagagtgttactagaagctagatgtttaaaatataaataacattatgtgaaatgggctgaagtgttatgcgttaaaacagtgctttcaactcacattcctttatatttcattcagtttttatattctgaggcaaatttaatgagcaaatccttgaaacctctaatatgatgaattacattttaaaagttaataactttaagataaactaagatgtcctttgttttgaattattcaattcaaaatctcaaacttcaactaaaatgacttctgaatagaaatatcaattagtactcaaatacaaatataaggttgatgtacataattatacatattttatatatgaaaagataagttagattgtacccatcaatgacaggaattataaacgcattcataacacatttcatggccatgaacattatgttgcaagtctcagtaagaaatatctcattattgtagtacaagaaagggatctcttacacaacttatgcctctttcatatttgctttaaatatttttatcttacacaatagaaagagaataattcaagcatatgaatatatgtcctaaaatgttgtttaatattgtaaattaccaagcttaatactgtaaataaaccctgtcaatatctacctttgggcagaataaagaaccagataaagctattttgggacctatttttgcttccttttcttttctgatacaagtgttcttttaaaaaatctaatcttcaggaagaatgtattatcagtcatttacatcatagtttaaatttaaaataattaactctctgtatattattatgaggacttcgaagaagattaactgataaattactttcaaatccaggccccattatttattagctaaatgtaattagacaactcatttaatcattttttgtgcttctgtttccttttctttaaaattaacataattccactgacagtattggtatctagcaggtaggtgaggatttaaagtagatagcccacctaatgaactttgcacagtgcctaccacacagattatttagtactcattaaacattagctattagttattattcatttaataaatatttattaagtgcctactatgagacaggagctttcctaagtgagagtattctgcagttataaaatcagcattctattaatttatttgctgttacacatgcaaaatatgtttgctcaaatgttatatctagggcatgagtaatatgcaatattccatattaaaatgtgatacttaattttgctattgaaaatagtaaaattaattgacttagtggtgaggacttgggcaaactacttttctgagtgtctaatcttgctcatctattaaattgaggattttgttgcatgatcaatgttctaacctctaaaattccaattctgtgaacatagaatgtttaggaggccccacaatccaaaatacaggctgtaatcatggcatctgtgagttaaaaaaacacctagagtttaaaataaattgttttctataatattttgtttattaatacaatttaagattgatacaaatttactgcttttctctaataatttaagaaatttagtgatatgggcagagttcaacataaaatagatattcaattattgggtcatatcagatgttataaaaaaagcagaaaattaaaatagtttcgtgatcttgtaattgggcaatgatataaacaatcatggtgaaacagtgccccagttacatggggttaaaaatactttcttcttccaacacagaaatagcaaatagagcctcccctcccatatgcaactagaaggggatatcattgtgcctttggagagaaaaaaaaatcatgctcgtttttttcaggaatgcagagtaaatctacttgatttatacaaagaatttagttctttccttgtaatgctagtaatccaagtggaacctggtaaaaacagcaagtaaaatactgctcagattggcattccaaaggtgaccctctttctccttgtcacttattttttcctattagcgaaaacaggtccatgatcatttgggggaaggtttgactattgtagtatccagatgccaatcacaccagccttttaaactgcctttactggtgaccctgcccagaaatcaggaactgcctttggggagatctttgtagcaaaccactggggagatgagcacacacatgcacctggatataattcccttttatttgtcttcacgagaaatgtgattactgatgttgaatatcttgcagatgagaactctatacagtttcttcataataatgatgttcaaggacactaaatgattgtcatacatttttgtatcatagtattcaccttcccaaaaatggttgaactaaaatgctttagaatacgaaatgcaattaattaccaagggatgaaaaaagaaatgcaaccaccaaaaatcaatatgtttaagagcatattctttatttcttttactccataatatttatgccttattgttattagtcttcttatttttagtgaattgggacatttaagcacttcattaaaagaaagctgattataagcatttatagtgaaggtgcaagtagggcaaacttcttcagatagactaattagtaaaagcatattaattctgaccttcaacacccttggtgtcccactatttgttttccttggagtgggagcaagtattttgacagaaagcgcttgaaaaaaataaaaaacaaaacaactaaacaaaaccccagttcttttcaagacagatttaaatcacaaattttacctaacctttgatgttagatttcagccctagttattgaaaaacaaatataataatctactatgtgtcctagaagtttaatgaacaggcagtaattatactaaaaaagtaaaggaaagagtaagaacatggtatgtggcagcaaagtaaaggagaaataattctcaggcagtgacaaaactctgctgtgttttctgattatgaaacaatcagaagagatgagaatggttgagttaatcagtttggactgaggacaaggatcaaaatgcatatcttcttagaataacagaagtcacactgactcatgataactagagatatggagatgtaaatgtcaagactgtttattttttattatatttagtagagaggtataagtaagttctcaggaaatgccttcaggtggcattgatggcactgcgagatgggagaggaccattatttccccattcatcaactacatcataagaccaatttaagaatgcatgtgttttaacccttgccttttaaaagtgacttattttgaagtacattcctgtaagtctcccttttttttgaaatattaatgttaggtaactggtaagctgagccaacactgaaaacaaactgtttttgttagctgttagcagtattttagttaacttaaagcatctgtttttgtccatcactgttaaaatttttcaaaatgcattgtcacctgatatataaaccacacgtgtgttcctatatactcatcccacatgcataaacatatgttttccagaaggtctctgggttttccgcaaccactcaatgggttctccttgcccactgcctagacagagccagtttatcaagacaggggaattgcaatagagaaagagtttaattcacatagagcctgctgtatgggaaacttgagttttattattactgaaatcagtctcttggagagtttggggatcagagtttttaagagtaatttggctggtaaggggttgggaagtgggagtgctgattggttgggtcggacatgaaatcctagggagtcaaagctgtcctcttgtggtgagtcagttcctgggtgaggaccacaagatcagatgagccagtttatcaatctgggtggtgatagctatttcatgagttaagggactgcaaaatatctcaaacactgatcttaaattttccaacagtgatgttatccccaggagcaatttggggaggttcggaatcttgcagctggaggctgcacggcttctaaaccatcattccttatcttgtagcaaatttgttagtcatacaaaggcagacaggtccccaggcaagaagggggtctatttagggaaaaggctgttaccatctttgtttcaaaactaaattgtaaactaaattttttcccaaggttaggtcaacctttgcccagcagtgaacaaggacatattagagtttataagtaagatagagttatttaggccaggtctctttcactgtcataattttcttagttataatttttgcaaagtcattttcatttctatatagtctcaaatatacctgctcaaattgtccagtgtcttttctgccagtatgttggcattttggaatcttttcaaagacttcattgcttaaaaaaaatgctgttgcttaatgatattttgtatcaatataacacattaattttaatttccccttcattcagcttaaatgggttggaaaaggaactttgagcagaaaaagaatcataattggtcagcaatggtagtgaaactagcacctttgaagatgattgatttttgatttagtaagatgaattattttgtgtatgttttcttgaaaaaaattagttaaaacatttaaaaatgtatagttatagttattttataccagttacagcactcttgaagtgtatagattaagttcctttctattcagatagagaggaatctgggaacatcattgtcaaaatgccatctctttcaaaacttggttccagtgctctaaagaaatgttttagaagattatgcactaatgttactggcggcaaattcatatagatctgtagccacctcaatttttgcattctcagaagaaagaatttgattgaggggacataaggcatattaagagaccaagacaaattttagagcaagagtgaaaatttatttaaaaattttagagcaggaatgaaaggaaataaagtatacttggaagagggccaagtgggtgacttgagagatgatttgacctttacttggggttttatataatggcatgcttccgaggtcttgcgtcccttctcccctgattcttcccttggggtgggctgtccacgtgtacagtagtctgccagcaattgggagaagttgaatgtccagtgtgtttactgaagttataggcatgctcacttaaggcatgtttccttgccagttaagtgttcccagaaggtcatataccggttaagcgccaacattttgcctcttagtgcgcatgcttgagcccactcacccatctcctgagatctcattgggaagctgctgatcacccgtctcaggtgtttctatctatagggagactgcctttccctggcactggctgtgactgattcttattattttagagagatagtgtaacaattatcacctgacggttgcctgacatttctggtggggcgttgtggggggcggtgcttctctgaccctgcccatagtctaactgccaactgtaacactaacagtttcattgaagtgggggaaatgttaagtaataatatgaaaaccatatttaaggtatatatatataaggaggctcacaaacatagccataggccgtttgtttggagctttgaaaagggaggctcagttccttgactgatgagcagtttccatttggaaattctttgactttagtgcaacttcaaaataaaggcatgagacagaaggagagaggaagaaaccctcaagccatctaaagtcatctctggcaatggtggccatatcattttcacaaaaaaggggcatccttggggaatatcataaaggaagaataaggacttaagggaaatgtgtgggaatgattgactgatcctccctccagcagaaaattaaaaatcaatgtagatgcatttttctcagcttcttcccttcatttttttcctctcctgaaacctgttcctccttccgtgtgtaccatctacagtgaatatcactattgccttaggcggaaaccttggaactctccttgaattggcacttgaactattcactcatttcctcccattctattaatgattcctcctctggccgttcttcctcggatacatctcttggaactacctgctggtcctacgctactgcctagtccagacctatgttgtgggcttctctgccaacagtttcaatcttctccaggctgttcttcaaacgaattatttttattggcattctcttgtgtaaaaccttttaatggtttcccagcgagagatgcccttcacaaacccttttctgcttacctgctttctacctatatacctcctcatctctcccaccaaggactggtatactctctagctctagaccattttttagtcccagtgcttgaatatagcacactctctcagatgcccatctctttgaacatattgatacctttgccgggtatgccctcatctatttgcaagtacttcgctttcctttcacctggctaattgctactcatcatgaaagggttagcttagctgttcccctaaataaacttccagcaaccccagcctcctcccatgccaaatctgggttgaggacctctcttatgtactactatagaaaccaacaattactctattttagctcttaccgcattctattaagacaggttgttcagggagctaagctatgaggacgcaaaggcataacgatgatacaatggactttggggactcaggggaaagtgtgggatggggtgagggataaaaaaaactacacattgggtacagtgtacactgttcaggtgatgtgtgtaccaaaatctcagaaatcaacactaaagaacgtattcatataaccaaatactgcctgttcccaaaaacacctgttgaaaaaaaaaaaaaactggttgtttgcttatctatgtttcatgtagactgaaattatgactatctttttcatgcttaacacatttgtgtcttgcacggcataagacatttaccagatactcaataaatatttattaactaaatgagtgatagaaaagagggaaatccaaaagatggatcacttagctgtaagaattatttaatggcaaaattcattatgcttttgaatatagttcacatttttaaatccacgtttttgaaagtattgatggtttagagtgataactcaatttgtttagtctctattggccttagatgtgtaagaaaatacattttaaactgtatagtaccagagacaaaaagaaatttcttgttaatggtcctcagttgctggcaaagttacttgtacaccagttgttatagctagagtgttatatcagaaattgttttctgccccaccatagctatcacattgtgttgctgaaaactaggtggttgcacatctcttagatacatgatctccttaggcttattaaattttgaggttaatgaatattttgacacttttacctatacatatcattagggcttattgcaataggtttaagatgacagtcataataaacatatacagtacaataaaaagcacttttaatcttgaaagtgctttaaaaacaacagtgatcaatgctatggatggattaacagcatcatgctgattgaattctatttcaaggacaatggaggtattgatgttggcagtctagttcagaaagtggcaatggctgtagtaaatggtgcaggttctggagtcagactccccaggtttcaaatctggctccccaacatgctggtgtgcgactttgcacaagtcattcccccagtgtgaaactcagtttcttcatctgttaaatggcttattgtaaggtttcaatgcaatcactgtaaaggattagtacacagtgtcttagtattgtgtatgcatttgtgaccagcattctgtaattctggacttcaattatgtgcctttccattgcatacatatattttatgtccctaagtcacataaatcttgttgatacttctttatgacctctctctactacacggtactctgatcattcactttattttactcattctgtgaacctctgacctgttttttgttgtcattgttacctttcttcttccactagaagcatacatgttctgcatctcatttctccacatctatttaaacagccaactttaaatgttatgtgtacttataaacctaactctattattccccctgtcttcataatcagtcttctcgaaaactaagactctctatgtgtcattttctcatggatcaattactcctcaatctactgtcatttggattcttttcttccacttctttattgtaaatactttcttctagattatcaatagttttcaagtcagagaactttccttaatcctcaccctatgtgccaataaataatattggtgccattttttccttttaaaaaataagaagaaactaaatatttctcactaggtttctccttctattttccctaaactgtgtttcaagctttgatattgctttctacatccacctttaaatggaagagttcaatcactcattcggttcgtatgcagtttttccttatttcactccactagctgatgttatgattgctgtcgtaaaaaggatactgagcaacacaagaatgattcctaaccttagggagcttaaagtcttgcagtgaaatcatgcatcaaacatgtaattaagtaattacaagtgacttctgtctccagctatgaagcatatcaaaaaatcctcctgctgagaaaagaaatagaagctggaaaaaatttctcaaaaatatggttaaagacataagtgagtaacaaaggcttctaggacttgtgggatcaagatcctagatataagaaaaaccatgtaggtgagccttttaaattatctttgtttttccttctgttttgtttgttaattcctctattgcatagtcttagggaaaaaaaaaagacaggcaaaaaattagagtctaggtggggtcctggtatacatgccaggttttcaattgaaatcctagaagagcaaatcattaataggctcttcttcctcagataaagcctcaattattcttaactactaattatactgagataaaagttatttttttaccaaaaatatttagatatttgctgaaagatcacatcaaccagagtcccagagtgtgcaattttttcctatacaatgtcgggcattcaatcaaatattaacaggcataccagaaaatagggccaaataaccaaaagataagataaataaaataaaaaatagaaacatatcctcaagtaattcagatatatggaaatatgtatttgcatacacacataggcatatacacacatatacatgtagatatatatgcatatatccagacacagactttaaaataactataattaatattatcaataaaatcaatgaaaatgttcagaatttaagtagcaaatgggaatatattagaataggaattttagagcggagtaacagctgaagttagcaactcagtagataaaataccaattccatccctgataaagtaaatagccttgttcttaatatcgtatgcaacaatgtaagttgggaacaaaatatatatgaaacacctatttgtagccaatatatagcaacagtgcagagctattatgcttaagtgaagaaaagcaaatgaactgagttgcacacacctggaattattgagctcaagcagagacattagtatatctggtaaaggaataaaaactggaattcagggctacaaaagtagatttggagggtaggttcccagagagaagattgatgctgaaaaataattcaaaaattctgtgtaacaattcttttttgggtgcttggccaacatttagaataatcctatgagaaacatagtagagaagatctgcttggtagttggagctaagtagagatttcacaggcaacatagagctaaggatgcacacatggagtttggacttaaccacagtagagaaaccttggtgaatactctgagctttcactcgactctccaaaagtccgtcctttatgagtaaattcccatgctttaggaataagggctattctttaggaacattgagataattgaaacagattcaccctagtgaagcctaaagccaaggctgagtaaggtcgaggtaatctggtaattttacttcccgtcaaaacagaattttgtattcattagtaaaaggtaaaataatccagaggttttactatgcgtcatccatgaagtgaccaataatgaaatgttaatagtcgatagaggcagacaaagacttcaaaataacttcagttaatgttaagagaaaataaaggacaaggtggacagaaaggatgataagataaaaaatatttcaatgcaaaattgaaatctgtacagtaattaataggaaaaaatggtatgtaaagtaaaatacctgaaatgaagagaatattgataagttttgccaatgaaacattgcagaaggcaagattagagaactcaacggtcaattgtaattgtccaaactgaagcatatcgagaaggaaatgaaaacatgaaaaaaagaacaatgaggtatttgaggacccagaaggaaagagtgaaagaatgagacaatagtaatattgtagaatagccaaatattatcaaatatgaaaaataagttcacacatagtttaacaaagtttagcaaaccataaggagggcaaatataaggaaagccatatccaggtatattacagtcaaattgcttaaaataaaagacaaagaaaaaccttcaaaagcacctggggagggtggggagacttattaccttcagtggagcaaaaataagaatgatgtctgagttttcaacaacaacaataaatgaatgccagaatataatggaatgatactttttaaatgctaaaattatttttttaacaataataacaacaaaagaaaactaccagtcaagatttctgtacccaggaaacatatccatcaaaaatgataaaataaaatatttttcttaacaaaagagttgaaaaaagttatcatcaaaagactggcattataaaaatcataaagtgtattaggacataggaaaagatcccaaaaggaagcacagagctgcaggaaagagtgcaaacctctagaaatggtaactaggtgtgtaaataaaaagtaatatttatgataaaaggcataaaaatcatactttgaagttgataacatgtaagaaaaaatgtatgacatcaattattttgtcacaaatgatgacggggtctatatggagctaaactgtggtaaaattcctaaaaagttatggaagttgaagaattaataatatgaagtaggccatagtagatcaaggattcagattatgatgccaaaggtaacaaccaaaagaatgatttagaaaattaatgtaaggaaacactaaatgttaaataaacacaggttaagctgataaaggagtttgagggtggcaagaagaagccagaaacaaagagcaaatgtggggaataaaaggacaaataccactgtggtgaacataaactcaactatatcagtagttgcattaaatctaaatagtctacccaaataagcataaaagttctcagattgatttaaaaaataaaaatatatgttgtttattcttataaacatactttaaatataaagacaaaattcgaaaacaaagaaagagataagatgtattgatatatagatagattttaagacaataaatgttagtagacaaaatggaggacatttcataatgacaaaaagatcaattcaatagagggacatataatcctaaatttaggtgctacttatagtttcagatatgtatataaaactgaagttgacagaaataaacagagaataaatatatcctcatagttgaagatataaatccccatctaatattttgacaggaaaagtacacaaaatattagtataactatcaaagatttgaaaatgaataaacaattacatctgtatataaaacatgtgacattttataagtgttgtcatatgtagaacatcacttccaacaactatataatatgcatttttgaggaacacataggacattttccaaatagttaatatcctgggctatagaaatcgcataatttttttttttaagagacgaggtcttactgtgttgctcaggctggtcttgaacccctgggctcaagcagtcttcccacttcagtctcccaaagtgttaggattacagatgtgatgagccactgcattcagcttgatctcataatatttcaagttctctgacaactgtgagattaaactagaactccaaatctaaaacataatccgattggaaaatatccctggctcaaaaagaaattatggaaattaaaaattatttttatctaatgataataatgccttaatacatataaaaacattgtaggatggacaatatcaggaatctgatattgctttatagctttaaatgcatatattagaaaaagggaatagttaacaatcaattagcttcccactcaagaagaaaccaggaaattaaagcagcatatgacacccaaaaaatatttgaataaaagaaattataaaaataagagaaatcaatgatatagcaaacagaaatgtaatggagaaaataagaccaagaattgattctagaaaatttggggaaaaatttctttgcaagtgatcaaggaaaggagaaagtacagattactactctcagggatgcaaagagccattactagaaatcttacagacattaaaaaaaataataatgtattaagaacagcactacgctaaaaccttgacaatacaggcaaaatacagagatcctttgcatgggagaaaaatctccaaatttaaactgacacaagaagatctagaaaatctatgtggtcctagatgtgttttaaaaatgaaatctatagttaagtcttttacataaagaaaaccccagggaaggtggcccgattggtggatttcatcaaacaattacagtagaaataatagcaatcctacaaaaaaactcttacagaaaatagaaaattgcaatggtttctatctcattttatgaggtcagaagaacttatacactaaaatctgacaaagaaattaacataaaggaaaacacaggtcaataataatcacaaaagtagattctaatattctctgtgtgtgtgtgtgtgtgtgtgtgtgtgtgtgtgtacataaataaaatgttatatcatgaccatgcaggttttattccagtagtgtgtaatcttttcaaaatgtatgtgattcaacacattaacatagtaaaaatgaaacattctaaattatcaccacagatttaacaaatgcatttaataaaatataataactattcataacaattctcagcaaactagtaatgaaagaacacatcctaataaattgtttttgtaaaagacctctaatagtaaaatatcaagtgctttttcccagaggtcaggtacaggacaaggaaattcactatcaccacttttatttaatgttgtactggaagtatagtactagccagagcaatatagcaataaaataaataagtattaggtatgtcaaagaagaagtaaaccatctttatttgtagatgtcattatttttattgatgtcaaaataatatataaactattcagtttactcagtaaacttagaaaagtgtcgaataaaggtcaatgtacagaaatcaaatgtttctattgaatagcaaaaaacaagtagaaaatgaaatgtttaaaagtaccatgcttactagaactaacacacataaatgacttagaaacaagtctgctaaaaggtaatgtaggacctccactctgaaaactacaaaaaattactgtgagaaattaaagaccaaataaatggaaagttacgccatgttcatggatctaaacacttaatattgttaaatagcaagtcttcctagtttgatctgtagaatccatatagtccctctcaaaatcccaggatttctgtaaaaatttacaagctaattttaatatgcacatgagagaggaaagtacttagagtagccaaggcaatactaaaaaagggcaaagtaggaaggcttatgtatcaagactaactataagactgcagtaggtaagcatgtatagtataggcaaaagaacagataagtatagtaataacatattgccacataaataccccaaataaatacatatatatgcagggcacagtggctcacacctgtaattccagcactttgagaggccaaggcaagagtattgcttgtgctcaggagttcaagactagcctgggtgacatagtgagacctcatctctacaaaaagctgaaaaattagctgggcatggtgaggcacctgtagtcccagttactcaggaggctgaggtaagagaatctcttgaacccaagagttcaaggctgcggtgagccttgattgcaccactgcactccagcctgggtgacagagcaagatcctgtctctaaaaaataataataatacatacatacatatgtgctctaaaaagcacatgcaaagttgttcatagcaactttatttctaataatcaaaaactggtaacaatccaaatttctatcaacagtagaatggataataaattataataaatttattcagtggactgcatatagaaataaaaatgagccaactattgcttcagagaacaatgtgggtgaatcttataacctgttagtgagtaaaagaagctagaatctaaagagtctagtattctatttatataaatttcttctttttcattttaacatttattttaggtataatgggtacaacatgcgggtttgttacttggctatattgcatgacgctaacgtttgggctatgggttccattacgcaagtagtgagcgtggtatccaataggtagtttttccaattacagtcccctccctcccttccagtgtctgttgttctcatgtttatgtccatgtgtgctcaatgtttagctctcacatataaatgaatatgtagtatttggttattgttccagcattaattcacttagaattatgaactccaactgcatccatgttgctgtaaaggaaatgattttgttcttttttgtgattgggtagtattccatggtgtatatgtaccacattttctttatccagtccatcattgatgggcacctagattgattctgtgtctttgctattgtgattagtgtagcaatgaacatatgagtgcatgcgtctttttggtagaatgatttatttttctttgggtataacaggattgctgtgtcaaatggtagctctgttttaagttctttgagaaatctccagactgctttccacagtggctgaactaatttacatttccaccaatcgtgcataagcattctctcttttccacagccttaccagcatctgctgttttttgactttttaataataaacattctgactagtgtgagatggtatctcattgttgttttgatttccatttctctgacaattattgatgctgcacattttttcatgtttgttggttgcttgtatgtcatcttctgtgaagtgtatgtttggctgggcgcggtggctcacacctgtaatccagcactttgggaggccgaggtgggtggatcacgaggtcaagagatcgagaccatcctggtcaacatggtgaaaccctgtctctactaaaaatacaaaaattagctgggcatggtggtgtgtgcctgtaatcccagctactcaggaggctgaggcaggagaatcacttgaacccaggaggcaggggttgcagtgagccaagatggcaccactgcactccagcctggcaacagagcaaaactccgtctcaaaaaaaaaaaaaagagatagaagtatgtgttcatgttctttcccattttttaaatggagttgtttttcttttgttgatttgtttaagttccttataggttctgcatattagaactttgtcagatgcataatttgtatattctgtaggctgtctgtttactctgtggatagtttcttttggtgtgtgtgcagagacactttagtttaattaggtctcagttgtccatttctaaagctgcaaagtgaaatcagtggtgacagaaatcagtagatggggtaataactgaaaggaagcaaaaagaagccctctgagattctggaattattttataaattagtctgagaggagtttataagtgtagatttattttgtaaatgtccatcaaaatataccttgataattagtgcactttatttttgttatactttactttgaaaagttactgaataaatgtttcaagcctgcaaagtccaaaaataagatgtgaaaaaatactgtaacataacagaagcactcaacccagtctagaggattagtgaagacctctccgaggatgaggcaagttgagttagctaggccaaaaaaaaaaaaaaaaagaaaaaaaaaagaaagaaagaaagaaaaagaaagaaggaaagtaaaggagtccaggtagagaaagtatcatgtatcaatgtcttaatgtgggagatgacatgtacataaataaacaaattagtaagcaagaaaaacttggaaattctaatataaattagattcttgccagaagggtgcatggtgaggctgaaataaaaaaggggccagatcatgcaagggccatcacattgaaaattttgaacgtaattttattcatctttataagaccactgtggaggttacagcctgataccaagaatgtttttaagaagggcatgctgatattttcactgatattgtacatgtaccattcatagattgactcactaaaagttgcaattttatttaatcatctaataagattatttatagaatgtctgcaaaatgttagaagatcttccttataagaattagcatagctgaatggtttaaaaaaaaatgaaattctgaatcccagcatggatctattgcattcttgcaattgtccaaggcaaaaggttctgcttgcctgcttcataaacaaaatcaattaaccgagactgcagcattgcagtaaaaagtttaatttaagccaagccagccaagtggaagaactggagttatcactcaaatcagtctctctgaagtcttgaaggttaggatttttatggataatttagtgggcagaggggctagggaatgggtgctgctgataagttgaagatgaaatcataagagcatggaaaatggtcctcctgtattaagtctgtctctgggtggggcaacaggatgggttgagtcatgagtcattagtccaggtgggatcagtttgaaaaacatctcaaaaaagcaatcttgggttttacaatagtgatgttatctataggagcaattggggaagtcaccaatcttgtgacctctgaccacattattcctgaacagtaagcaattataaaaattacacctacattttagcagcattcaggcccctcccgtaatcctattcttgtggcctttcattagtcttatgaaggtggtttttagtctctgagaagggaggaggttagttttagggagggatgatcatctatgatcatctttgctttcaagttaaactatgaactaaatttctcccagtgtccaggaatggccaaagacagcttgaaggttagaagcaagatggagtcaactatgtcagatttctcttactgtcgtaattttgtaaaatcagtttcatcctaatctctggagaagtacctagaaatttgcatttggataagatatacagatctacactattaaagacagagctatcttacccacccccaccccagctatttgtctaagggaaatgaaacaatttgtacatacaaaaggctggcacacacatacgcattgcgcctacattcacaagagccagaaactggaaacaactcaaatatccatcagtaggtgaattgattaataaaatgtggtatatgtatgtgatgaaatactagtaagcaatacaaaggaaagagcagaagaacacttaatcgtaattccacttatataaaattcttaataataattaatgtatagtgacaaaaaggagatcagcagttgcctaggcctgaggaggagggggtgatggaaatgctgtgtaacaatcaaggtagtggttttacaagtgtgtacatctgtcaaaacatatcgaactgaaccatttaaacagatgtgcttcagtatatatgtaaatttttatctcactaaaattaataaaatattctccaagtgattcttgcaacattcaagtatgggaaccattgatttacactgtaatgaacaagttgctttaactttgtttggaaaccaaacaattttaatattattttaccatttaaattctgagctctttcagatagaaacttaagcagtgtgtatactgcttatcactccaaatttcacctgaaacaaattggtatatactgtttgtcataaaaataagaaaatgactttcattaaattatgctgacaatgagaatcttgtacaatttcaatgaaataactttttttaatgaaatagggtttcttttgatctcattcacattcagaagggaatttttgtaaatagaaaggactatattttattttatcctaagaaggaatttagtcagtaaaaatatgaaatagacacttgagtatacagttgaccagttattgccttgaagctactgcacctctgtaatgtatttttcatagcttatataatccgtgttaatatgctacattattaagttcaactgtgagaaatatagttgcttgaaaacagatttcttctgcatacttataaattcagtagttggaaaaaaattaaagaaatataattaaagattgcaaaatcaatttgaccctcacttaaaatgtgttgagtggaggcagcaagcagcagcctacatctgatgctgttctctccttgtttacttcacaaaactgtgcaaattagaactttaatttacagagctgttaaagcctcattaaaaactttcagcaagtatcctattttgagggtttttttccccttatatctaatatgcagcattatctctgttttgtgggcatgtatgaggcaatatctataggcatattaatgtaaactgcatatatgaaatgaaagtttttcacatggaaaggacactagtggtgtctgtcaattgcttcccaaagtgattaatttctccatttacttggtgtttattggcatctactaacactggatctctgttggatcataggaatataattgggctccagtgaaatgggagaattccctgacaccctgttgcaggatatgtgacagaggtgtggcttgtctgcttgaccgccttgcactcaaactccttgcaggagagggagcatgcagatgggcaggtgtgggagccagggcaagaacttttgggctccagtcccatggtagtatctaggggtgggtgcttgtgactcccaaagccccagtgggtgtgttacaatgcccttttagctgtgccatccacatatggcttaagtgttaaccagctcagtgctttcttggtacctgggttcttgtccggtgtccaagaagaatcaggttacatggataaactgaaggatggtaaatgtgggggattttattgctggatggaggtggctctcagtggaatggatgggaaactggaaaggggatggagtgggaagatgatcttcccctggagtttgggcatccggcggccaatctcctctctgactaaccccagccgaaatcctctcaatgttcagatgctccttttcttctcttcttctatgtggcactgctctgctattctcctgttcctctgctcttctgctcatggagcctggggtttggggtttatatgggtataggatagtggggcatggtgggccaaaaggcaacacttgggtgtgaaaacagaagtgcctttttttatttagggctgtgggtttccaggcttcagggtggggcctttgccagggaactgccctcttctacccagcatttccctgcctcctgtctttatcaccagtagacttgttccctgctcttacaggatttcatgcgtgtccgtgtgaagagaccaccaaacaggctttgtgtgagcaataaagctgtttatttcacctgggtgcaggcgggctgagtctgaaaagagagtcagtgaagggagataagggtggggccgttttataggatttgggtaggtaaaggaaaattacagtcaaagggggtttgttctctggcgggtgggagtgggggtcgcaaggtgctcagtgggcaggagtgggggtcgcaaggtgctcagtgggggtgatttttgagccaggatgagccaggaaaaggactttcacaaggtaatgtcataagttaaggcaaggaccggccatttacatttcttttgtggtggaatgtcatcagttaaggtggggcaggacatattcacttcttttgtgattctttagttacttcaggccatctgggcgtatacgtgcaggtcacaggggatgcgatggcttggcttgggctcagaggcctgacattcctgccttcttaataagaaaaataaaacaaaatagtattgaagtgttggggcggcgaaaatttttggggggtggtatggagagagaatggacgatgtttctcagggctgcttcaagtgcgattaggggcggcgtgggaacctagagtgggagagattaagctgaagggaggtcttgtggtaaggtgtgatattgtggggatgttagaagaaacatttgtcgtatagaatgattggtgatggcctggatatggttttggatgaattgagaaactaaatggaagatacaaggtccgaataaaagaaggaaaaaaatgggtattaaaggactaagaattgggaggacccaggacatccaattagagagtgcccaagggggttcagcgtaattacttgcttggttggcaagtttttgggctctatccttgagtttttttatgttgtcatacaccaggccagattgatttaggtaaaaacaacactcctcatttaagaatatgcagagtcctcctttttcagcattgagtaagtcaaggcctcggcggttttggaggacaactgcagctaaagagtcaacttgggcctggaggactgataaagtttgtgatatgtgtgtgatgctagcagagaagtcattagacaggctacagaaggtcatgacagacgttgaaatgcctgctattccagtaccgagagcaatcatggaggcagaaagtcctaaaccgaccatcaagggaattagtggaataactcttttttgtcatgtcggtgtcatgaggggaacagggagctcttcggtcccatttgcaaattgaattttgggggtaaggaagactagtgtacatgtggctgtccaattggcaggtagacacatgtaggtagaggatccacagaggaagaagagaccttgtgcgaggcaaaactggagatgtaaagtaaaaaggtgagaaggagtgctgaaaggggtgtcttgtacccagactcctagggatccacctagggcggcagctgtcagaggttgtaatggggactgatggggtaactgcgtagagggggaggttcgattttcatggtgtatgagaaaacgttgagtatctacgagcaacctttcactgttattttcggggctgggtataagtaaacaagaagagggcctgggaggagagtctgatgagcaaggggaaggtagccaaggatggagtgaaatacagggcacgtgtcttcctaagcaataattactgctaatgtttttaagtttgtcagtattgatagagggcttgtctgtaatatggagctggaaggctccaattgtttcagtgatgtgtgtagttggacttcggagatgaagagtaaaggaacatcgagaaggtgaaaggttacccaggggaattccagtgggtctttgccgagagatacataaaggagcagccacaggaatagtagtttgtgttgtgagaggtccaaatatggggggagtagagttaatataaggagaaaggttttttaaataagtgcgaaggagggcggcagcttgctgatgtgaaatgtctggggaagtcttgctgaacctgtctagaaagtaaatgagttcttcaggagggtaaaggtgagggctgttaaaggaagttcggaggtgtagggagacgggagatgttgcccagtctgtctgtaagacggggacagctgtgtaggcactggaagaaagggaaatgcaaagccagcagttgttcgctaaggagggattagaagcagctaggagagaatgggttaaggttgacagtgtggtggagatagctggggagaggtagagggtgacataagaatgggaatgagaataagagtgagtataaaagtaaagaatagaacttcatcagggtggaagtattggagggtgccttgccagcaaagatcatctatccactttaagagggagttaagagtggcagtttggggatagcaccaagagatatcagctgtgatggcttgaagaaacagtgtaaaccagcagtgtaaacaagagtagggcatttataagtagttgagaatggagaataggagtatgaccggacagaagatagtagggatgactagttttttggggctcggcctaagtggtggggtgacttcgtaaagccctgttgcaaaaagtagggtaaggacgaacagacctaatagaatgaagggatgtattaggctcataagggttattactgttcttcagaaatacgagtgagtttaagggaagtgggggagagtacttgcgacttccaggaggaagaggagggattaggctggctgtccgatggacacagctttattctggaatggtgaacccagtggggaggatcctgcaggcggacggcagtcggggtactatagatgactaagtagggtccggtccattgaggttatagagtttgaggggtcagattcttaacaagaactgatcgtccagctaggttgtcttcatatggctggggatctggagtaggcaagagaagattagcagcctggcgaatttcctgtctagcctgctagagcactggaagatagtagcctagagggctggtgtctgggatgaggttggggccaagcaagaaagtgcgtccatataaaagttcaaatggactgtaccctgtagcatctcggggacaggctctgactctgagaagagcaagaggtaaaagtactgtccaatcctttttaagttggaggctgagcttggtgaggtgtgccttttaaaagaccattagtccgttctacctttcctgaagattgaggacggtaaggggtatgaaggttccactgaataccaagagcctgagaaactgctttggtgatttggctagtaaaggctggtccgttatcagactgtatagaggtgggaaggccaaaccggggaattatgtctgacagaagggaagaaatgaccgtggtggccttctcagacccggtaggaaaggcctctacttattttgagggcctctaacagtattaaagcagcggcagccgctgcacacagacatgagggctaggttaaaacagtaaggtcaagttgtttggacagaaaggctacagggtgtggtcttggctcttgtgtaaaaattctgaccgtgctaaccatgcctaggaaggaaaggagttgttctgtagaaggtgcttgggtttgagagattagtcggacaggattggcagggagagcacgtgtgtttttatgagaattatgccgaaataggtaacagatgaggaagaaatttgggcttgattgaagtaatgggggctgtctgtgaagctttgcagcagtacagcctaggtaatttgctgagcttgatgggtgtcagggtcagtccaagtgaaagtgaagagaggctgggattaagggtgcaaaggaatagtaaagaaggcatgtttgagatctagaacacgataatgggttgtagaggcaggtattgaggataggagagtatatgggtttggcaccacagggtgtataggcaaaacaatttggttgataaggtgcagatcctgaactaacttgtaaggcttgtctggttttaggacaggtaaaatgggggaattgtaaggagagtttataggctttaaaaggccatgctgtagcaggcgggtgataacaggctttaatcctttcaaagcatgctgtgaggtgggatattggcattgagtggggtaagggtgattaggttttaatgagatggtaaggggtgcatgatcggtcaccaaggagggagtagaggtatcttatacttgtgagttaaggtggggggatagaagaggaggatgcaaaggaggctttggattgggaagaagggcggcaatgagatatagctgtagtccaggaatagtcagggaagcagataatttagttaaagtgtctcagcctaataagggaactgggcaggtggggataactaaaaaggagtgcttaaaagagtattgtctaagttggcaccagagttggggagttttaagaggtttagaagcctggccatcaatacccacaacagttatggaggcaagggaaacaggcccttgaaaagagggtaatgtggagtgggtagcctccgtattgattaagaaggggacgggcttaccttccattgtgagagttacccgaagctcggcgtccgtgatggtctagggggcttccgaggcgatcgggcagtgtcagtcttcagcccctaagccgagaagatctgggaaggagtcagagagccttgggccagagttccaggggctctgggagtggctgccaggtgagttgaacagtccgattttcagtggggtcccacacagatgggacgcggcttaggaggaatcccgggctgcgggcattccttggcccagtggccagatttccagcacgtgtagcaagctcctgggggaggaggttctggaggaatgcctggccgctgcggttcaggcgtttggaagttcttgtgtgctggagatgtggctggggtttgtctcacagtggaggcaaggaattgcaacttttttctattatggtacaccttgaaggcgaggttaattaaatcctgttgtggggtttgcgggctggaatttaatttttggagttttatttaatgtcgggagcagattgggtaataaaatgtattttgagaataagacggccttttgaccttttagggtctagggctgtaaagtgtctcagtgttgctgccaaacaagtcatgaactgggctggatttttatatttgatgaaaaacagcctaaacgctatctgatttgggataaagaaaaaggagcattaaccttgactatgcctttagctccagccacctttttaagagtaaattgctgggcaggtgggggagggctagtcacggaacgaaactgtaagccggaccaggtgtgaggaggggaggtgataaaaagattatagggtggaggagcagaggctgaggaagaattgggacctagctcggcctggcgaggaacaacctggggaggaagggagaggtcagatgggtctgtagaaaaggaagattagaaagactcagcgatgcttggggttggtactgaggggacaggcaggagggaaagaaggaagatttgggatgagtttaactggtcacagagactaggaagggactgatgtgtaaaagaatgcctggatgtcaggcacctcaggccatttgcctattttatgacaagaattatttagattttgcaggttggaaaaattcaaagtgccattttctggctatttggaactactgtcgagtttgtattggggtcaagtggcattgcagaagaaaataaggcatttaggttttaggtcaggtgtgagttgaagaggttttaagttcttaaggacacaggctaaaggagaagaaggaggaatggagggtggaaggttgcccatagtgaaggaggcaaaccctgagaaaagagagcatagagacacggaggaggggagtggggttcttgccctccagaaaagcagagagggggttgggacacggaaataagggattggggcacagagataagaggtcagggtgcggaaataagggattggggcacagagataagaggttggggtgcggaaataagcgattgggggtttcttgccccctaggaaagcgggacttgccgctaagggtgaaggagaaggggttgaggggtacttgcccctgccccaggaaagcgggacttggcgctaagggtgaaggaccaaggcaggtgtccctgcgtggtctgacacccttgaaacgtgagtgtataatcagagaggtgtccctgcaatgattaaacaccaagggaaggctgccttcccagtctgtgaccagcgccggagttttgagttcacggataaaacatgtctcttttgtctctaccagaaaatgaaaggaattgaaattaagagaagggagagattgaagtgtggcaccaagattgaaaggagaaagcggttgagggatagtgagggaggttggagaagagagtaaaaaaggccgcttaccggatttgaaattggtgagatgtttcttgggctggtcggtctgaggacctgaggtcgtaggtggatctttctcacagagcaaagagcaggaggacaggggattgatctcccaagggaggtcccccgatccgagtcacagcaccaaatttcatgcgcgtccgtgtgaagagaccaccaaacaggctttgtgtgagcaataaagctgtttatttcacctgggtgcaggtgggctgagtccgaaaagagagtcagcgaagggagataagggtggggccgttttataggatttgggtaggtaaaggaaaattacagtcaaagggggtttgttctctggcaggtaggagtgggggttgcaaggtgctcagtgggggtgctttttgagccaggatgagccaggagaaggactttcacgaggtaatgtcatcagttaaggcaaggactggccatttacacttcttttgtggtggaatgtcatcagttaaggtggggcaggacatattcacttcttttgtgattctttagttacttcaggccatctgggcgtatacgtgcaggtcacaggggatgcgatggcttggcttgggctcagaggcctgacacaggacttgtgggaatataatccatggctgtttgactactctgaactgttatactgctgtttttctgcccagggggatgttaaagccaaaagcaagtaatcaacaagattttttttaatcttaaaatactgaattaagccttaacctttaaaacaatttttgttgtagacatagatttgctatttgtttcagacatcctttaggcttttgatctagcacatgactaccccttcttaccgcattgcccctggatcccccaaggagagacacatggctacctcctttgtaccttggcccttgctgtactgatcacagctagttaggacagctatgaaagcctgctccatgcagaactgattctgttcgcatgagaatttggaattggaatttagagctaaccagttggtctgtgtttgtcctgaacataacataaaaattaattgaaatgagagacagagagaggtgtattgttgtgggggcgggtgagaaagtagggtgagggaagggaaggagggaatgctgaagtatagagcagagagcagcagagaggtgagaaacaggaaaacattcctcaaagcttctccactcccagtccaggaatcttgcctagccttgagttacagaacacactgttatctctggataatacatttcctattttgctcaaagtcctggtgtgaatatgcaaccagagatttttaacgtaaaaagaagctatgagcatatgaatggaagttgaagacctgagaatggactaagggactcagggttagggacagaccctaggaggaaagatggcattcagagatagatagttaaaaaacaatcaagaaaaagtagccagataagtaggtgaagaactgcttgacaatcaaggaaagattggtgaattaggtaatattcatttgcataaaatgttgcccagtggtcaggtaggcgaaaagctgaatataggcagttagattttaccatttttatgtttctatcccctgctacctgactaaactattttcaaaatgtattttatagcttagagccttcccaaaattcctagtattatatataaatttccaatacatattgatagctgaacaatcatattttcctggggtttattttaataatatatgcatttattttagccaatgatattcacaaagctttgctgaaatgtgttttgtttaacttggttctgtatatttttccatgaaaagccatactaaaaggacattttccaagtattaaaaaaaaaagcaaaaaaccctgcagtccagaatgcataatttgttctgggatagttaaaattctaagagaagtcttctttgttctttccttgctctttctttgttctccaaaagggtcgtatttaaactatgggtcatttctcatctgaatagccagggaagattagctacattgctactgatgcacttgatattttctcattacataacatgtggccacagattctagccagtctgataagataaaatgttcataatacttagaagataaaagggaatcatcactacttaagatccctttaaatccaatctgttgatctgtatgagattacatttttggctctcatttactagttccccctaaagaaagtcttgatatagctactgggttcctggcttgtattttgatagtcaaaacggcagtctggatatttttctactcagtagatacaatagaagaccaaagcttcttgcattgtagtcactgaccttgccatgtcatttcatattttctgtagatttggtcctggaaaatcaaatattaagcaagtttgacagttcagctaaattccataaggtcatctatcacattacatacagtaattgattttacgttaattggtctttagtttcatggttcatgtttctggttttctggtagtttccagaaactttcgtgttaaatgaagagctatgctatgtaaataaaattcagtaaaacttccctttcattttaattatgtgcttttgaaaactaattttattgggttctttaaaaaactccgtaggagtcaggcatgaattttctactctttagggcatttcaatcatgaaagaaagaaccatctatatttttcatcatctcaaaacaattttagaccactactatttgtaggtacaaataatgttcattgatttgctttatatttattaatcacctaatagttatgaaatggtgccctaagtactgtgactaaaaaataaatattagtaagttaattttactaatttttatccttaggagctttaatttatgctagataatatctgagaaaaagtcaatagtatgatgctgtttaaagaaagaaagcaactgctatcctgtgttgttgtattagcagaattgtcaaggataaaataaataaggtgaagattagactccacttggcaatctttagcccttgattggagtaccatgttccatttgggaaggcacacttattacaacatagacaagtttggcagaggtttcaaaagaaagcaacaaaaaaatgatgaagggccttgaaaatggggcctgtaagaaaaggctgagagacgtgagaatgttcaatcttgaggaaaaaaggcagaggggacacatgataactgtttacagatgcgtaaagaggtgttatggagagaagagggacctatttttctcattagtcaacaaagacacttcaagaagtaatgggtttaaaacacgtggggggaaattcaggttaattattagattaagttaggtaaaatttaaatatttaaaatgttatgattccaagcataattaggctgtggagactaaatcacattagaattggcataggaaagtgagatgaaaacaaattcaatctgaatgcagagggttaattattgcaagtttatatttgcattaaatgttatcatatttcaaaatactttcacatatattgttttactgatctctggacattcttaggaaagagagagtgtatcagctagttttacagctgagaaaatggaatttcagagaggcaaaatgttgcttcgaacccccacactccagattagatagacaaaactgctaagtgcataggattagacaagcaggactaaaagccaactcttcacattttctgtcaatatgtttcacatggtaccttgctatcttttcatttgtaatatgatttctattgtggagaaatattgtttacatagaggaacaagaaacatgattgaacttatatctgcattacctatatctattatttatctctcactactcacaattgtgaaataaactcagcactttggtattatattttgacaaatcattgccaaacgtaatacaatctccagttggtatgatgtggtgagaccctaccttctaccattacctagaggtggagacacatttcatcttttatgaatttcatattcctcatctgtaggaagaaaattataatatcttctggtttcttctagttttacaataaggagtgaatgagaaaatacctgtagaagtacctgaacttgttcaaagaaataaacttgttcaaagcataaactttgcttggggggaaatgtgtgttgtttttggtgtactgtggattttgataatccctttccagttttattttcaatcctaccttttttttttttttcatttcctaatttcagattcctgaggtcaaggccaatgtctttgttgaagcacttaaaatttgctagtctaatgtaggtgttcagtaatagttggtgggtgactgagttaacaaatggatgaataaatactttcagttggatattatgtctgggatatgagcaagaggtgataaatgccatatataatcatcttgttatactcctttatgtaatgatgtatgtttaaagtattttatagaaacatggtatgccagattctcagttagatcctgagaatacaagccactcaaagtctaaaggggttttgcagaccactccaatgctaggtatagacaaaactcttcccagcaaagcaaggtagctgatgccaaaatgttaccaaggaaagacccattggttggttgccaagacccttatggagtctgagaagatgttttagactccctcaaccatgcacacaaattgtgtaaagtaatccaggaggcagcctaaatggaaaggctgttagtatgctgagcttgctaggaaatggaggaattttacggaaaatgtcagcctctgtagactcctgtgatgctcgctagggtgccagccttccccagggagcccacagcacctggcaggcagactgcagcagggagtctcactgggaggatacaaaagagcttaatggccccctgtgcataatgttgaaagaggctgcaatttttgttttcttcggagattaacgtgtgtgtattgcaggttcaaaatggtaagaatcttaattagagttgcaggaagttgcataatatactccatgtcttactttttccgcacaccaaataacagaatctatttgccaaattatgaaggttgatggagaatgaaaactgtaatttgagtaaatgggagccctgcccccattttttccagttagtcacaaagtttaaaatgcaaagaagtaaatctcccaagggagcaattctatttcatctgtggaagaaagacatatgttgttactgatgaaacctctgttgtgaaagcagagccaatgctgggaaaaacttgaaggaaaaactagctgagagccctctgtctcaggagcctgtggcctttgggtccacccagggctgcctgtgcctcttcctgaggcttttcttgaaggcctgctctttcctctgattaccttagggcaattgcctgcctctcttaagagaaaatgtacctgttttgtgccacatcccttcaggcccctgagctggacagtagattgatctgacagatgtcactttgatattaaatcaatagtaccaatatgtttctgggttttcctggccttagcaaggttttatgttcacttacttagagacattctggagaatatctcagaactcaaaacatgagatcaaattggagttctatgggagagaggatattgaattacttggctttattatggctgcactcatagggccagccacgtgtaaaagtttcattctctttttttgaacaaatatttattgaaaacaataaattaccaagaactgtgttaaaatatacagatgtctaagcagacacggcacaatctatggccctaagaagtctaggaggtacaatattttatataaattattcatcttcattcaaagttatttattgagcatctactatgtgccgtgcactgtgcatgcccctggaaagcataagagacaaaattcctttctttgtgggagctgtattctagtgaggttcagcaggtgaacagcaatccgtgttaattatttcttcttccactgaaatgaaaattctatgtttctaaaaaatattataaaagtactcttcaaacctcatattaagaaagtcaaattgtctttagccacatttgataaggattaaagataatcttactattttattttaaacatatttagagcagtccttgtctgaaggaagcttgtgttgaattttttataaagtgagttaattaccttctaattaattttgtgtgtgtgtagtgctcacctaacacaagattttcatgctgaatttgctcccccaaaagaaaaacaattcctatatatgttgtaaagggtcgcaagtcagaactgagatggaggcaatacaaatatataaccagcggcctcagacaagttcccaaaattgggaagaatgaagagatagggaatgactgcagagcctttttcaggaaagcatgagattggaagatgaatgctcaagtaaattagaactcaggaaaagtactgaacagcaggatcatatcatcaaaaatctggctgataggttttgaactcactgaactgaatctatttagaagtacattttgggaagactaaataaacatcaacactatggtctattctaattcaggctcttgctttgtctattttccaggtgataaaacactgattgttattagtgttatcatcaagcatattgagcagtcaatctgtaagttaatagcaatacacagccatatagtcctggaactagaaggaaagaaaatgaattttttcttttttttttttctttttttttctgtagaggggaagaaaaattcaacaccttgagtcagctgcgactcaagggtccattataacttcgagatttttaacagcctgtgcctagggtatgggagatgaattttgttccaaagtggtgacatgggcagatataaacccctgggagcaatttcaggcaagttgagagtccattctaaacaaaaatggacagaatgtggaagatggaattcccacacttgctttctgaccttggctgatattcctcagcagttggtaattagaggaaatactgaagctgagaggatgaaagaataaagaagagtagaataatcagaattgaaagaatgtaaataagtaataagatggggcaaaaacaggaatggtgtcactgacaaaggtggccacactttgcagtaagatgtgagtgggacatagaaactagatttggttgagtaagaggaaaaccatatatacacacacatatatatacacacacacacacacacacacacattaatatatgcatatttaaaaatatatacatttcaaaagctcatttatgttgaatactaagtgggaaattcatcagctgtttggcttcctgtctgttttattctttgccattgcagacttgagttgtcttcctgaaatctttctgggagataactgcatgcccagcccttttctttcatcagaaaaagggtattctgccctgagtcagaagcagggggaaaatagatgataatatctacatgttattgctagaacagagtcaaataaaaattaaaagtccatcaagtgatcaggttgaagtcaataaaaaggtcaataaaaagcaaggatgagccaaaaaagaggacttggtgtactggaaaatgccaggaaaaataaaagacagaaaaaacactgtggcaagatcttctcctgtggcctcagggaagtgcatgataaaattaattgaagcttatcacccatgaaaaagggctacagttggagcaatagctgcacggactacataacagtacaggttctttagcctaagacaaagataacagatttttgttttacttttgcaagcttttttaatatactgagttaaaactctctttttttgcctttattcaactgaatgctgcattttttgagcaatactaagtgttgattggcttacttgaacagcaatttgttaagaggcctgctgtgtaccggccattatcctaaataccagtgtacaaagattagtgatgtgtctatctgctttcaaaactcttataatctgtagcaacatgagattaatttttacatatggtttatatataacaatctaattccaatacaatcatatcattctccatatctcataagaaattgttttgggacattatttaaagaaaactttatacaataaatctataaattgttagtagatttgactcctcctttagatgaaagttttcatcttgtcgtttttttaaattcaaaatatgttattttaagttgatataaaacaatcatattagcaaaatgcatccacattgaaaacttagctggatgggtaaagatcgctctattaaactgtgatgtttaatactgagtgtcaacttgattggatttaaggatacaaagtactgatcctgggtgtgtctgtgagggtgttgccaaaggagattaatatttgagtcagtgggctgagaaagccagaccgacccttaatctgggtgggcacaatcaaatcagctgccggtttggctagaatataagcaggcagaaaaaggtgaaaagagagactggcctagcctcccagcctgcatctttctcctgggctggatgctttctgcccttgaatattggactccaagttcttcagttttgggacttggactggctctccttgctcctcggtctgcaggcggcctgttgggaaccctgtgatcatgagttaataaactcttttacatgatattctcatgatagtgaataaatttcatgagatctgatgggtttatcacgggtttctgcttttgcttcctcctcatttttcacttgctgccaccacgtaagaagtgcctttcacctcccaccatgattctgaggcctccccagccatgtagtactgtaagtccaattaaatctctttttattcccagttttgggtatgtctttatcagcagcgtgaaaacaaactaatacaggcactgttccatctccaaatggtcataatttatcagttcaaaggaacgtactttgcatgccaccaaagggttttctaagaattgggtcagcaattttaagtcaaggttgttggttctgagttgtacctttgagtcagtctttcagcattttagttctcaaatctagttttctactctttccaatggggttattcatccaatagacatgggaaaatcatcctaatcaaaacaaatttatgatcatttctctctggcatgactgcatcaggtagcttaaaccatagaagtttattgtctcacaattctgaaggctagaagttcgagaaaaagatatcagcaggattgatatcttctgaggggctgtgaggaagaatctgttccatggttcacccagcttctggtggtttgctggcaatctttgatgttccttttgcagtgtcaccccattctctgccttcgttgtcacatggcattttctttgcatgcacatctgtctcttcatatggtgtttcttttataaagacaccagtcatactacagtagggcctcaccctaccccattgtgacttcattttaatttattacatctgcaaaatccctatttccaaataaggtcatattctgaggtatgagtgggttggactacagcatatgaattttggggagacataattcaatccattataatcatactgcataactgacgagaaagtaaagaatcaatctgatgcaggaaagataacctaatcaaaaagaggaattaaacaactccaactaattccttacatttaatctatttaatataaaattataattttgcaaacacagcatggtgcactatggtaactaaagcaattggatgatatttcaaaagctttaataactagtatttaatcacagatgctgtgtgtttttacctgaaattcatcctggtaatgcaacataattaattgcacaatttattttagcatgagttttcttatatttatagagatagcatagcaatcttgttttcaaatttccctcagaatgcttgagatcagacattattagcatggagacaatagtttcattgtcaactcctgctggtttgggtacatttacagtaataaccacaatccactagcttgaattattgttcaacattctatgtgacttcatgagggtattaatatgcaagagagttatttgatactaatcaaagatacacatttgtcttcacacttattacaatatggtaaggtaatcacataaaatacttaagatggtagacttcatacatatatatatatatacttttaatgaatatactaaagctaaccgttaatggaagctttgacagaaactcattgttcaatatccaagcaaatcaattttggactataaatgcagaattctaacaagcaaaaattctaatcattcattttatttttctgttattcgtggcttcttatattgttaaggcttaacatattaagatgcacataggatttaatcttcatgagagagcaatgaatacatcattgaatacataccaatcatgtgtaattgttttcatatgtatgtaagcccagcggaaaagagtcgttcattgacagtactcattttcccatttggtgtattttcctaattgtacagtataacagttatagtaaatggttataaatattaccctttagctgtaacatctatgacatttttgttgatcatgataatatgtgattgtttagtcaactgagtttattgtaattgagattggaaatcactataagagtgaaattgaatatatagatagagaaataggataagttaatatggcagctcaacactgaacacagactacaacttcttgaccaccgaaatatgcaaaatattatataatagcttgtatctggacagcgtgctaagctgttcacttgttctttatcatttaatcctcttttcaaatatgtgagatatgttctgagaagataagcaccttgttgagtcatacaggtaatacattttaaaggaggaatttatatacacttaagattgtgtgtgtgtgtgtgtgtgtgtgtatgtgtgtgtgtgagagagagagagagagagagagagagagagagtttcaggctccaagacagatattaatggtagactgcctttgttgcataactgtagcagtggtgtacaactgctactcccatcttctcagtacttcatctctttctttgaatcaactacagctattctgatggctagattatgatctgccagtttgagaatccaactcttgctggccagagacttacagttaaaaaataaatcatttagagtcatatgcttatgtactactgggctgtgatcctcaccctaaagctcactttggcatagctctttacttgccatcgattcttgacagccttatttcagaattcttacagacacagtgtctatttaattttaatacaatcaagcaatggtttctggacatatttggctatttctttgaaaacaatggaatctgtcttatgggcaaaatgacttttttctgccctaaatgctgacactgaattgcgttcaatcatgacagaatttgtgcaatatgaaaagtttgtccactgggtggacaatttctatctagcatttttctctccttcagggatggactttaagttgatttgacaaaattggtttcatatgaacccaaatgcaaaccctatattatctttaaacactggtttctgtgaagttgtttgattaaactaatactgttgactccctgttttctgttttatttctttaagatgacatcccttattctgttctgctacctgggacattgctcttctctccatattaattaattaatattgtttcctaaatctgtcttcctagtctctgtgtttgtcttcaccatgtgtattgggatatattctcgaagggtttcatgtgtgaattccctcttgagtcaaattgtacatgtaatttcccttcattttaaaaataaataagaaatatgagaagaattttcaaaacttttatgttctatatgctttcctctggtttggaaattaatctctgaatttatttatattttaggtattgcaatttgagaattagaagagttgtttttacaaaacacagaaaacagcttttgttttaattatttttcccagtgtgtctaagagtcaaaaagactctgtattagtattcactggcaaacagaacacaatgcagagcagatatcctagaagcaacatgatagatccaatcatccgattcattatagtacaaatattgtaatcaatcataatattcagtgttccataaatccacaattctgtgaaagggataagaaaaaagaaattaagctatcagtgagtttactaaaaaaggaaaagagatttcctgattatcatcattcagaattagtcagacatatacatggtaatcattcatattttaagcaataaaaggaaactcaacacaaagcctggaaagcaacagccttttatttttattttctctaagatgtgaaaaaatagacctaggtgctaatttaattcccttttaagttaatgacataatgggtttgtggagcattaaatagggaataaatatggccttacatttccatgtcggagctaaatgctttctcttccctcagcttctaattcctcagctgagggaagtgatcagcagtcaacgatcacaatgagggagctacgcacacatcctctggtttcctgagctttggaacacttaatgcttagtgcagcttctctattttgagttctaccatgaacccctctctgatgactcccacatatgtcttttttatgtaagcacaccaagttcagctatccctgtaggtagacagcatttgagacttctcagttgggtatgatttgagaagataatggagctgatcctcttgacataaactagcctattggtcctgcccaaactggtgttccctggaacagaggcctaaaaacaaaatatatttaaaatgttcaaatatatttagaaaatattgtgttaaatcaagttagccagatttttgttgctttcattgtcatttttgttaatattgttgcatgatttccagaatattcagtatgcaaataaatattcattatgaatttaacaaaataggtattttctaaacttctttgaccttggaactcttgttctcccttcccaaccccaccattgcacttattttaacattgcactcagcagggctatacgcatcaacattttgggaatttgaggatgaagatatgtttttcctattaaaaatgaattcttatcccactgggaaagaaaacacattaagcttttatcagtctttaacattttaacatggattagccattctgctctttctggattataagcagctgagagcaggctttcattatagggagagggaaagatgatctgaagtgtcatgtgtccccagagaggattttcaagtggaatgccaccatgagagttcctgggctagcagaggacaacttcatatagtgcagggttgcagcaaggccactgacaccagctgtatatagaaagttatgtttgcctcagtttcttcagccaaaacagaggaaatttactagatagtagctatctccctcttagctctaacaatacaatctgattatcttgatggctaagtgtgggaactgagagagttagaagagtgggggtcactagttgaaaaagcaaggttagaaatgaatgttttctcagtcatggctggcctagggctggctctgcaggagttcatgattctcatctccccaaacaacaaagagccatggaaaattcatcagataacagtaattcaacagataacagtataaagactatacatatttttaagatagatttaaaaaatgcatgacatatttctggcctccaatgagtgttcagtatgaaaaaataccaactagatgaataagtataggcaagcaaaagattctaagtataagaaagtgtgaaaagtaaaatttattttatttttctttgaaagagcagtcttcccaggtcaagagattagaaagacaagtaaggtaatgcctcttctctgaagtttagaacagatgaaagtgacacataaaagcagaataagataaatattatatcatagtaaaaggaatgagaggttgtatgtagagtggttgtggacttggactcaagagcatgtggacacaaatttctaggttaaattccctggattcagaacccatttctaccatcttactaggtctgtgtcctcttgtgtaaatggtagtggtgatgataattaccatgcctttctgctagaactattattaggaggattaaagaaaattaatatgtataaagcatctagaagagtgcctcacataaaataacaaacataagtatttactatcattaataataaattatatccaactagaatcattataaggggttttagaaaagaagtagcaataagataataagtgaagaatgagtaaatttttgaagctacaaatggattgaacatagtactctagggagagggacaatcatgaatgaatacatcaagatgaaaagtcaaagggtaaattttagaaatagcaaatagattggtttgctaatataacatactggccctttactgatcatgttgatcattttgtgagaaaacagtaggaaatgacttcagaaagaatatagtttggtaaaaaccattttaactgtaggagaatgaaactggattctcatctctcaccttatacaaatatcaactcaagatggatcaaggacttaaatcaaagatctgaactaaaaattctagaagataacattggaaaaacccttctaggcattggtttaggcaaggatttcatgaccaagagctcagaagcaaatgcagtaaaaacaaagataaatagatggaacttaaccaaactaaagagcttttgcacagcaaaaggaatagccagcagaacaaacagaaaacccacagagtgggataaaatcttcaaaatctatccatctgacaaaggactaatatccagaacctacaacaaagtcaaacaaattagcaagaaaaaaatgaacaatcccatcaaaaagtgggctaaggacataaatagacagatctcaaaagaggatatacagtggccaacagacatattaaaaacatgctcaacatcgctaatgatagagaaatgcaaatcaaaaccacgacacagtaccaccttactcctgcaagaatggccataatcaaaaaaataaaaaaataatagatgttgaagtcgatgaggtgaacagggagcatttcttcaccgctagtgagaatgtaaactagtacaaccactatggaaaacagtgtggagattccttacagaactaaaactaccattagatccaggaatctcactcctgggcatctacccagaggaaaagaagttattatatgaaaaagatacttgcacacacatgtttatagcggcacaaatcacaattgcaaaaatatggaatcaacccaaatgcccttcaatcaatgtgtggaaaaagaaaccactgtatatatatatacgtgatatatattgcatatatatatgtgtgtatatgtatagtatagatatatgtatatatatagtatatatacacatgatatataatgtgtattatatattatatattatatataatatatataaatatatattttatatatataaatatatatgatggaatactactcagccatacaaaggaattagttaatagcattcacagtgacctggatgagattggagattattatcctaagtgaagcaactcaggaatggaaaaccaaacatcatatatgctcactcaaaagtgggagctaagttatgataatgcaaaggcataagaataacacaatggactttggtgactcagggggaaagggtgggaaggcagtgagggataaaagactacaaatagggtacagtttatactgcttgggtgatgggtgcaccaaaatttcacaaatcaccactaaagaacttactcatgtaaccaaacaccacctgtgcccagtaacccgtggaaataaaaaataaaagaaatttttgcccaaaccaatgtcctggagtgtttctccagtgttttcttctagtagtttcatactttctggtcttacatttgagtctttaacctatttaaatttgatttttgtttatggcaagagatagcattctagttttattcttctgcatatgtatatccagttttcccagcatcatttattaatgagactgtattctccctaaggtatgttgttcacacttttgtcaaaactgcattggctgtaaatatgcagatttatttctgggttctttattctgttcttttggtctatgtgtctgtttttatgccagtaccatgttgttttggttactatagctgtgtagtataatttgaagtcaggtaatgtgatgcttccagctttgttattttttgctcaggatgtcttggactgttctaggtctttcgtggttccatatacattttaggattttttttcgatttttataaagaacttcattagtatttcgatagggattgcattgaatctataaattactttgggtagtatggacattttagcagttactgattcttttaatacatgaacatagaaaatgtttttatttttcatatctttttcaatttctttcatcaatgttgtattgtttttattttagagatttttcacttctttagtttattccaggtattttattttatttgtggcgattacaaatgggattactttaattatttctttttcagattgtttgctgttagcatacagaaatgctactgatttgagggaaactcttctacactgttggtgggaatgcaaattagtatagccgctacgaagaacagtgcagaagttccttaaaaaagcaaaaacagaatggccatatgacccagcaatcccactgctgggtatttatccaaaagaaaaacatcagtatatcaaagagatatttacactctcatgtttatttcaacactagtcataatagccaagatatggagtcaaactaagtgtccatcaatggatgaatgaataaagaaaatgtggtacatattcatgatgaaatattcagccattaaaaaagaataaaatccagtcgtttgcagcagcttggatagaactgaaggacattatgttaagtgaaataagctaggcacagaaagacacatattgcatgttctccctcataggtgagaactaaaaaaattgatctcatggagacagagagtataatgatagttatcagagcctggggaaggaaatggggagggggataaagaagtgttcggtaatgggtaatgggaacggaagtacaattagatagaaggaataggatctaatgtttggtaacaaaatagtgtgactataattaacaataatttattgtatatttgaaaataactagaagagtggaattggagtgttcccaacacaaagaaatgatgcttgcttggggtgatgcatatcccaattatcctgatttgatcattatacattgtatgcatttgtcaaaatttcacgtgtggcccataaatatctacaactattaagtaaccatgaaaattaaaaattttacaatttaagaaaagttaacttgacgagaaaaagaatacagtttggaagtcttcgaggatagataggaagagattttccatttaatttggttttaaatgggatcttgtctatgtttgctcagggtaatcatatgaaaggcattataatttgaaagcttaatctcaaaatagtactttttttggtaaccagttgtcttgcagcaaaaacaaaagcactgaacttgggtcaaaatacgtgaattcaaatccatactttataccttcagaatcaaacactctaagcctcattgcgttactctttaaaataaggaaagtgcatctaaattacacattgtttttagtagcaaataagttagatgaaaaagcatcaaatgtaatgttgggcatacataaattttcaatcaacttttaactatataatattatctgaacaagacaagtgaagaatacaattgtaattttttaaattgcaaggcaacagtttctaccctaataatatctacattttcctcataaaagtcagtgcatcagattctatacagtatgctcttcaaattcttggctccaaagttagcaaattaaacatcccatctcatttctagtttgcagtgaaattctcaaaaagtttccagaatccctgatgttactcatcctgagctacatctgacttctaatcagcatcttttacttagaatacagatagcaaatctggttggcagttattttccaatgattcttctgccatactgatgctttataatggctccaaggaaaggccattctacaaataaaagcaaaattaataaaagaatgcgggataattgacagttttgctacaacagcatttaatttgaatcctttgaaacttactcttcactcattgatttttaggctcacaaattctttgtgtgaattctctcttttacttttgcattgtgaaatgatttatcatttgggtaattttccagaattacactttattattttgtaaatggcatgcagcacagatggatattagcaaggtctctgtataaacgccagcaatagaggtggtaacattgccctgagagttttctcctgaaacaaatcaaataaagaagagaaagcattgccaaagctggccatgacagaggaagtggatccaataatagacatctcgatggatacatatatatgattcaatattgtgtgacctttactttcaaactcactttcagaaaatatattctaaaggggtgccaaggatattgctgtctactctctactgacttccatgaaaggaaacaccattcctctgtatctcagtcatcaatgagtacatttatgaaagagtttggccattgtcaattctaatgccgttaagaagaacttgagcatagcttacatttttttcctcattttactcctacttgtatattgctttggcatatactattagtgcaatgctgtgacttccaaaacttctcagaaagtaacaacttggactgttaagagactccagcatttgaaatatattttaatgcaaactgtctccctgaagacctctatccatagctaagatagttgtatccgaaagctttgcgcttacttctttgcagtgctatttgtaaacattggcatagtaagagtgataaatttctatggaatcatctttatcaaacatacattatagaagtagaacttattccagctaaccacattatcatgaatagcattttccatatttctttgaaacaatacaatagaaacaatattatcttaaacattaagtatccccattgattggtccagtgaaatactgcttggaatgaaggcttcaactttaaatctatttaatcaaatttggtaaaacaatcatggatcaaatatattattaatgttacgtggcttttattattattattattattgcaaaaattaggagccttggtttttgtggccttattctatttcagttagatataatatctcctggccttgggtgctttttacatacaaatggggtaaaatagttattataaagaatagagattgaatagatgtgcttagagtaatgtctgacacaaagcaagcactcggcccagcacagtggctcatgcctgtaatcccagcactttgggaggccaaggcaggcagatcacgaggtcaggagttcaagaccagcctggccagcatggtgaaatgctgtctctactaaaaatacaaaaaattagccaggcatagtgccatgcacctgtaatcccagttacccgggaggctgatacaggaaaattgcttgaacttgggaggtggaggtagcactgagctgagatcccgccattgcactccaacctgggtgacagagcaagacctcatctcaaaaaaaacaaaaacaaaacaacaacaacaaaaaaagcaacggctgttaattgccaggaagaagagctcctacaattgtttcatgtgcatttaggcactctcttccatgtgagaccccaagcagtcagcaggactatcaaaggaacccttttaagacttagatatctatttttaattcttgcactgcatttctactttgataaggggaaaaggcattaaaacacatttttgaaatgtaaatttccaaagttacaaaaattaacccaacacatcatatgctctttgaatcacttaaattggcagctgtcttataatgataaaagacctacggcgttcttagatgatgtctacatgatgccagacagctaattgaattaaggaattaaggaagatatcaactagtccttccccttatttgccagatgaagaaatggaggccaagaaatgtgtagtgatttatttacatcaggggttgagtctgttggtcgtgagaacttctagcctagttattttttccaccccatctatctgtcctgaaatttggtttcttattgctgcagcattgaagagatggaaccactaaaaaaatactgataaaaagatgtttatccagaggcaactttaatggcaactcaaactatttgaaatatgatggaaaatttgttactgagtgaaaaggccatcgcacaatcaaaattgatgtttaaagctcgcctactaactcttccacactatccaatgtagtggtcctccttcattttgctctttagagtttccctaattttctttatgcatgcatctgatttcatcttactttagagaaaatactaacagtgtatgtctagaacatggcagattggagccttatagcacgagaggcagggaaaagacagctaatagcgattcactgataggagaagaaggggtcccatattgtttgagttttagataacgtttaatgatcttcctggataacagattctatgaggattttttttttttgcttgtttaaataaaagctgattcaatgataacaaaaggagagacagtaacttcagaaaaatatagatatgctaattcttacatttgtagagcccttttgatattaaggttcaagatctaaaaatgtaattctcattcaagaccgtataaaaattgttagttctatataagcatattgaatcactgatagattaaagcacattcatcatactctagaaaacaaggaaatgtgtaatatatttgatgtcatttttattacaattgttaaaatagtgaagaataaacctgttaactagaaatctatgcatgcagaatgtcttattacctaaataacaccagataaatgaggtgttactgtccacagtctcacaacagagacatgaaaaacccttctttacactggtaacccttaattaaactgaatttttggtgtgtcccttcaggagaaggtcaccatatcagcaataattaggggaaatggcattgtgaacattactggatgagatgtggtgtatttcttactttcaattattgcctccttgtttgaatcattagcatttggcagatttgttgctgaatttgttgttctgatttaaaactcggtgtaaggttgaatatgttcttatcttgatcttatatttctgccatgacttgcatttcttgctgagtttctgacttgaattgctctatgtttttgctgagcttttgctttgtcttgttgtatttctatctggaggggtttccctccgcctttttctttttgttatatctcttctttggcctattgtatttctctggcccattcattagctttttttttcctttaaagttattctcttgttcagtatatgcagtacctaatcaatacgcttccttgcttgctgcaggatttccaacttactgtgttttctgtcagctttgatactgcctgagaggggtttctgtgctttggctaatatattgttgtctgaattcgcagtgttttcagctcattacactgactttaattttgatgtatttgtattttatccagttcaagtcatgtttctttcctctgtcaatttaattactttctgcctgggcaacattgtgtttatacaattgctgctaaagcgacaaaaggtttctatttaaattaccacccagagcatcagcaattcagcctaaaaaatatgcagaactcctctgattgatgtcttacctttctgtggataaggaaatctagtctattgagaggatcttctttatagaacatagtcaagcctggtttatagctgtagagtcattaacagaggagatgagtgtagggctatggggtcactgtatgacttctctgtaagaaaaaaatgtatgactaggttctattcagtacaagtcatgtcctaacagcaggaaaaagaaaactttcttaggtgtttaacttatatttaggtgggctacccaagctccagctcttatttttctatgtgttatatatattatacacatttctgggtttgaatcttgttctttctaataattttgcattgggctgtgtaagtcaggaacattgaatttccattgtgtacataaaactatagcaactggtctaaaaacaaataatgtgggaaacatagtaactgttcctgttttcaaaggcttacaataatgcgaaaaaaagggaaaagcttatgagcaatacatctttgaaaacagaaacagtgaaaacactccagtaaatacataattggttattaatagaattttaaattggagaggcataacaattgcaacagctcttggaaatgcttaggaaactgaggcttataggtttacccgaacatatgtcatagataacattaatcaactagctgatgaacatgaccagcaaatgcattgattgcctgatcagcaaatgcttcaactgttttgttttacaagacttaatatgtttaaacaacaacttactctttacctactttttaaaaatatccttctgtattttctgcaacaaaccattgttgagtccctgtgcttaacaaaactgtgcaactgtgctatttacccagaggaagaagaaagatttttttaagtcagttcttttctggtaagtgtaacttttctagtattggataatctttctgagcctcagttttcttatctgtataattggcataaatgaaccatgagaaacaaataaaatgacatattcagctcagtgtgtgtcacatggtgagagacccattaagtttgctcttttccttttgcctttctcttttcagtgttcagtcattatactgtcaaataaattggagtttctggcttttctcacactcaagattattatgatatactacactagtacatctgaccttgataaaaagcaattttctatagtttaattgtatagcaataggatgggaaagtctctgattctcactctgtagcttcttcttcccagggctggagtcatttaatctctacctttaggctcattctaccctggtcccttgggtcatgaattcatctggaagattcagacttatgctttaaggctctcagaaactcaatcttgcagaagaatctggcctccattttgtacacactttgttcaaagagcctcctagcaccttcccaagacccacatataccactcccattttctctcttggttctggtgattgactctctttatgttcttggaaagctgcctagtatcctaaaaccagtattgctgcctggctgttaccaggctgcaccctcgactaaagttgatcccctgcactcatctttggactctagatttctattacatgcacatcccttgtgccaaattatgctggcttgtctggccttccaagtttcacctattgttatgcttatttgtcagttcaagtctctattccagctctatcccacttccttctttctttagcctgtgtccctctcttggatccctgaaacattttgagtactagctactcctatgtcctgcccatgtgattaagaatgatacttttctcccgtgcttgcagctgggtagtcatactccatacccacccaggtaaaaatgtctggatccaaatctacctttcataacagatctgatgtgctattctagacagctttactccatgatatattgcagactttatgtaggttaacaaagcattatggtgtcattcttgtgacagccctacattttcattatgatttttgtgtttgcggtcctttttgtgacaatttcttttagatgaaaatgcttttaatgaagcccttttggtacttgggagcctcactggaatggatttagtacaaacttgccttatttcaaatttatgttcaatattgaacaacactgttacccatatttaggacagtagacaggtaaaggttgcagaatttttatgaaatataaagcaatatccactgttataatgaagcactacataaaattgtataatacgtgagtttcttattcctcaaatagtctaactgattgttcattgggctcactcagccaaaagtagagggaaactttgtacagacatcattagtttttctccatttagagattaatcatgaagagctctggctctttaattctgtaatttgtatatttaatgggctgctgcagaatctatgacagtaattagcatagcctgaaaactcattaatacgcaacaacatgattaatgcagcattaatgcaaacatgactgaagttatttgggttatgtagtaagaagattaaagctaaaatgtcctgtttgttttaccagtggtgagtataatagagtggcaaaaaaataaaataaaaacaggtatcaaattagctgtttaaaaaaaagaaaaaaaccagcaaaatttaaatcaaggtgattttatttttcccttaggtctaaaatttgggatataagttatgttctttacttttatatttattcatttattcataaatttatcattactgaaggaaagttcattcaaccttttagtttaacatagttaaccttttagcagctttaacataatattattagtcttacattggaaacaattttaaattgtactaatctttgaccaatacattacacatttctgttttgaaactaatatatattattggctatgccaaataattaaaggatttgttcctacttattcagaagttacatattatgccctcttctcactgtgttcacctcttaaataaatgttcaaatactttataaaatactaccataaaactcatttttttaaacaaaactatcaaatatgacatgttaaatactgaaataatcaataatgtttggggatgtaaaagtatataagttttgcttgttcttgctgtctcatgtaatcatattgaagtcctctcattcttacttttttttggcttttcttttttgagacggagtctcactgtgtcgcccagactgcagtgcagtggcgccatctcggctcactgcaatctccacctcccgggttcaagcgattctcctgctcagcttcctgagtagttgggactacaggtgcccgccaccatgcccggctaatttttgtatttttagtggagacgaggccgggtgcggtggctcgcccttgtggtcctagcactttgggaggccgaggcgggtggatcatgaggtcaggagttcgagaccagcctggccaagatggtgaaaccccgtctctgctaacaatgcaagagattagctgggcgctgtggcgggagcctgtagtcccagctactcgggaggctgaggcaggagaatggcgtgaacccgggaggcggagcttgcagtgagctgagatcgcgccattgcactccagcctgggtgacagagcgagactccatcgctaaataaataaataaatacataaataatacagacggggtttcaccgtgttggccaggctggcctcaatctcctgacctcagatgatccatccaccttggcctcccaaagtgatgggattacaggcgtgagccacagtgcccagccattttttttttttttttttttttttttttttttgctatttagtatgacctgttttaatagcggtcctaaactttaaatgacttatttttcaatcttatagtcaaatgtcaagagtcattaatagtatctcaaacaaaacttgcattttaaggttaagcaatcctggatgactgaaaaaaatatgtatctgcttttttgtacttattttattctaaatccacattagaaaaatgtttatgattttattctttttcaataaaaaaaaacaagtgaatatccacgaagtacctgactcttggctaggtgttgaggaggaaaagcaaacccatcaatgtctgtgcacttggaaataaccatctgggagaagagaagctcctttcaacctagggatgtctatagataagaatgaaattgcaccatagaaagaaagcatatcaacattgcctgctaccaacagatggcactgttaatggtttgtatcacaactgtatttgtgggaccaatagatttgctaacattctcagaaggtagtctggaaggagaagagcctctgttaaggcagtgaaatgatatacatgctcaattttgtttaattatcttgtcaaaattcctggaaaaaaataaaaaaatatatttatatgggatatttcgtttaattaaaatacatcatcttttaccaaaattaatatatgtgaaattaaattgtagtagaactttaaaacaacatagagttcctattgctttgaataattggtctttacatttagtattatattatatgttatattgttatgtataccatatatataatgttatattatatactgtaatattagagtagcaactgatactcacaaagctaaacaactcagttccactgaaatataccagattttgacttagttttaaaagggaggacctagaaacagagagaaaatgcatcagtgggtaaaatcatttacctctaatgttttatttcacctctatggtttttagtgtactagagagctgtttaatcagaccattaccaaattgaataaatggctacttagtgattactgaactatttagtgatggggttggggagaactccttttttaaaaataagccttttgaatagttcatataagaccatcctaataaataaaatggaacagaatgtgtttgccatgtaatagcttagtgatttttaatttctgtattgtgatgaaacaaccagcttttctagaatgtagccagtcctttgtttctcagaagctgtgcacacttgcggcattcagtcctagtgctgccataacagagtttctaaacactagttcagaaatgagacatttttgtttagtctctgtttgggcacagccaagagtttaagactgtacatggagagaaacttgcttttttctgtggatgtaatccaggggacctgttgaggtctttaatgggtggctgacaggatgaactgggcattcaatattaaagggtggtatcatagcaagggggttaccccagcagagtttgtagatcaggaattgtttagagcctagatcttgggaaagtgaacaagaagcatgttaactaaagataaaaaacagaaaccaggtattgtctttttaaactctgagctcttggagtggcgatcatgtcttttccatattagtatctccagtgatgagcattgtctgttggagacactcaatatacatttcttgaatagagtaaggatttactggactttgacacagaactaaggttctgtgtgatagaggtctgtgtgcttatgagaagctggactgtgtaggtgaggatgctaaggctcctgttcccatagagaagtccttgagatggctcaagctgctggttcccttttttcttggactttgcaggtattcaaggtgtctctagttagaagctttatgttttgtaatgggtaaaaatagtgctaaaatatatagctctttgctatttataccaaattgagggtctctcagaacaaatacagtggacggattttaataataatagctaatacttatatagggccaaatagttctgagtacttttcatgtatttaactcatttaatcctcccaaaagacttgtgaaagaagaaactctcgttgcccacttctagaggaggatattaggtgtagaaaagttaaacgatttgtccaaagttacatataaattaagtgcagaagctagtttttgaaagcttggctctagcatttgttttttaatcattaagccaaacatcaaattccccttcccacactttttttttcacttttaccaaagaaatatcttaacaaaatgactcctttggaggaggaatacatgcatatatatatctgtgtatacatgcatatatatatctatatatgtgtatacatgcatatatatatctgtgtgtgtatatatatatctgtgtatatatatatacatatatatatgtgtgtctgtgtgtgtatgtgtgtctgtgtttctgtgtgtatatgaggtcagagtgagggccaagaagctattttttctctaaagtggttcatatattgcaagtgatttaattgagggaagatatagttgtattagctaaaacacttaaaagtttataaataggtgtgtctacacaaaggcaaacattcctctaatttctaaacagtttttacttctattgaattgaatatgcctaatattttagtgtcctgatgattaaagtatgaggaatgaattaataaccaggttcaaatatgtgtattgttaccatgcagatctgttaatacttattaattcccacatcagtgtgaactaaggaaaatgaaattaagttgcattaagaatgtgctcagttatatataaagatttacttcctgtaagagtgattatataattatatggtttactaaaatagttatgagattttattctttcattcatttgacatgcattattggaatcttagtattttcaaactacgtatttggagataaatattgcagtctgaccataatgatagtttaggtattccttggcctggaaggaggacactagttcattttattaacatgttctttgtctgtggagagcctccacaatgccattttagtaaaatactggatctttactaaaccatggctaccaaagacaaagtgtcattctaggcagccaacagacttcttgccctactcctgacaagcaaaataaaatagcctggggtaagagaggtaatggccatgagttaagtcattttcatagttatgctaaatcagcttccctcaggagcacccccttcctttcctttctctgtttaaatgaggtggagtatgatgtgactattccagcacactcaaaattagatgtgtgatcaagtattgatcttcaggaagttcctaatcctgtctgatgttttctgtgttagctttttttttccttctgtcataatgttagattagccagcaccttcattttgttattcccttactttttaaggcaggattcttctgtacaagaaccctgaagcgaccctaatattgtatccaaaatgtagggtcagaatcaggagtggagactgtgagttcattgtgagttaacagtctattatttaaaagtgcaacaagaaaaatagttttgctttcattccatttctgggactctaattttttccaagggagtctggcataaagtatcgtattggtccaattgcttgggatccactgagattgttactagagagggctttggtgtaaaaccccagagtaaaattctttaatgtccttttgggtcattgaacactttctaccattatgcttgacatggacaccattgaaatcattccaaggtcaaggtcactcagcaattttactaatgcttcaagttagtggaattttatttttccccccataatgcttgttttacaaaataaaatacagtatattttagtagatattgtaagatcaatttttgaaatttcttttatcaaaataaatataaattttatgaagtatctgtatgtttattatatgtaaacgtgcaattacaaatatgaaatataatttatatacatgtatctatgcatgcacctggatcttatttgaggtataaaacatgaaactagaactaatgtgttttacaaatatacgtaaaaagttattatttttttaattttatagaaacacagagtaagtaatgataaaaattcatttgtattaaaaatatttttataactacaattagtactaacattttgctttagcctaagcttaaatgctttatttgctagagtcacttgttaaaatactaaaaattttacaaggtatgaaggtaaaatagaaattatttcaaaaaaacaaaaatgcatgctgaattttctcttttcctttataaaacaagcaagtcctttatgtagatttctacaattcataattcaatgtcattaaatggcattcaatttatattttagactattatgatttcaatttgagacacaattgttttccaaatgaattcaatgtggggtatatttatgtaatagatgaaatgtatttcatctattttggaattgaataaattcaatttattcaattgtttggaattgaataaatacagtacgtataaagggaggatgaaaatgtacaactattggatgttgatagaagcattctgaataagaagcatttttacaataaactcaagtatatttttataatgtactttttaataatacactgattttaaaagtcttttttataatgtactttcatatattttttcttgagaaatcttgatcttgtattgacaattgcataaatatatttgtgcccagcacaatggcttacgcctgtaatcctagcactttgggaagctgaagagggagaattgcttagtccaggagttctagaccagcctgggcactgtggtgagaccctgtttctacaaaaaagtcttttaaaaattagctgggtgtgatggcacatgcttgtagtcccagctactcaggaggctgaggtgggagaattgctgaggattgtttgagttcaggaggtcaatgatgcagtgagctatgatcacgccactacactcaagccttacaacagagaaagaccttgtctcaaacaaaacaaaacaaaacaaaacaaaacaaaacaaaaataaataaatatcttggtatgtaagggcaatttggggttgataatttggagagggatggaaagatacatagatgcctatatctacatagatagagctctctctatacatacggatacagatataaatagatatctatatgcagatagatatatatctatgaaaatacacatctaaataaccatagatatctattaatatctatgtatctgtatctatctatacattttaacttaaaactttatatacacataagcctatagttctatatttgtagctaagtttaaaaagctattcaagggaagccctgagttgttcttttatggcatctggtggcatttcatatttgacgtgttggttgctattggtgtttgcactggtgaatccttccactggaaatttcatttcttcagggtttaccaatcacctaaaatgttttctttctggataatatcccctgactgctttcttcctcttttagcctaaagtttcctaaaaatttaaaatgcattgtagtcagctttacttacctttcacagaatagcaactcaagaagtgtatgctaagaggaggaataaaattatgtaaaaaatgaactagaaacatagttacctaagacaaaaataataagtggacaaaccaagagtaaacattttacttaagggtttaaaaatgatatcaatttttactagttagggacaatgaataatgcttatcacctccactgttatttagtgttgttctggatgatataacccatgtgtaatgacagaaaaaagaattatggctgttgaaaaggaatagatgaaatttccagaaaataagtttatacctaaaaaagccatcaaaacctattataaataacagaagtacaataagatggttagctataaataaatacataaaaataaatattttttccataattcagcaataacaaatctgaaaatgatctgattcttaatatcaattaaatatataataagtactatagcttaacaagaaatgtgcaggatctatttaaggaaaagagaaaagaagaacttataataatcattttaatacaaaagagtgaattagttgataggtagctaaaagcagaattttaaaaatttactaaaaaaagcaattttgtaagtaaatttgtaagtaagaaagaaaactggaatatatccctatctcactttacatgtcaaaataaattacaaattttatatttaatactttattttttccagaaaattaaatataaaaatacagaaaatgaacagaaaaaatataagtaagttacaaattctgggctaggaagcccaattataaaaagcaaaggaagacgccattattgaaaacatttagattttaaaacaaaaataaaccccctttttacatttaaaaataacatttaaaagtcaattgttaaaaaaaagtaaatgactttaacaagtgacagacaaagaaaccatacccttaatgtggaaaaaacgcttacagatcaataataaggatgcacaaatgacaaaaaagtatccaaatgaagaactacgatgaaagttcaaaatcactattcatcttgtaaatacaaattaaaactagaataagatttcattttaaatctatcgaatactagttggcgtctttcagaaatgccaggccaaactattcctgatgctagaaatgttttgcctgacagtggctgaaaactatttataacatatggaaaggaaattacacaacttgagaaatttcttgcagtgaactcagaaatgaaaaggcggttagatgacaatttcagttcattaatttataaattcacatgctaccacagattttagagatcatgcaattcagtatctccatttaagagtaggaatctatgggctattctgctcaggaaatcagcactatagcatgtatatgtatttcataaagtatctggtggatattactttcttgttttgtttttttttttttttttttatcatttggaggttgtaaagcatgatcagtccttataagggtcacatttagacagctacagattttaatcgttccaaggaaggaatgggggattatttcaaaagacgaaagaaaacattctttgatctaaaagcagaaccaccatttgacccagcaatcccattactgggtatatacccagaagaatataaatcattctaccctaaggacacatgctcgcgggtgttcattgcagcactatttacaatagcaaagacatagaatcaacctaaatgcccatcaatgacagactagataaagaaaatgtggtacatatacagcatgagataccatgcaaacatgaaaaaaaacaagatcatgtcttttgcaggaacatagagctggaggccattaccgttagcaaactaatgcaggaacagaaatctaaatactgcacattctcacttataagtgggagttaaataatgagaactcatgaacacaaaggaacaacagacactggggtctatctgagggtgaagggaggcagaagggagaggagcagaaaagataattattgggtattaggcttaattcttgtataatgaaatcatctgttcattgaacccccgtgacacaaattcatgtatgtaacaaaccttcacatgtaccccacaacctaaaataaaagtttttataaaacacatttctttgttttatacagaccagaatgaaatcatttctcaacacttcttttacattaaagcacattattcttgtttttttcctcaggtattgccctactttttaatcctaatctatagttccattgtaatttttagaatgctaatctaatatttattgaattcttttgtagtaagcaactgaaaaaaatttaattttcaaaaggaagaaaaaatacatgtttaaataataagataacacaactttggtattctaaggaatgtttggggattcattccagggcgctcatattttcaggttagctttcaactgttattttgtcgagtataatcaatggagattttgttattcatgtatttatagagctggttagccataaatagtttatgaatggagacatttctagcaccacctaatggcagtcaagtaaaaagaaaaagtttttctaatttaggaactgttttgcataatttaaattaaactatatagccagagttacttccatatgaaaatgaacttttacattccctaatgcactaactaggcatggaaatccatctctgagcaattggattgagtaggaatgaagctgaagggatatttgataatgaaaccaaggggtttctgctgtctttatgtgtgcaagaataagaaaatacctagctaatagaataaattaattttatgtgaaaattttctttttagtttcagaagcctatgcatactagattttccatactgtagtttcctgaaaaaagtatattttgagtattgtattggcatattttatttgtcttgtttttcagcagttatttatacatctttgaccaatttattctactagtttaataaagcgttttttaaagtttctgatagtttttttaaactgagtcatatcattctgattataatattggaattttctgttgaatatgagtcaaagaacatgctttagatccgtaagctctactcatttatttcatgtgtttcctagcaggatttgaagaatgtgttgtctgtcataaccctaggattgagatcaatggatttggttaatgtatccgaaggagaaggagaacttagcgatagcagcagattctgacacctttcatcctcgtctcaacactttggtttgatactttcttctatgatataaacagggaatactaggcagactgcagatacaggtagttttttgtttgtttatttgtttgtttgtttttgagatggagtctcactcagtcacccaggctagagtgcagtggcacgatctcggctcactgcaacctccaacctccgcctccaggattcaagtgtttaccttgccgcaacctcctgagtagctgggattacaagtgtgccaacgagcccaactaatttttgtatttttggtagagatggggtttcaccatgttggctaggctagtctcaaactcctgacctaaagtgatccgcttgccttgacctcccaaagtgctgggattacaggcgtgagccaccatgcccggccagatacaggtagttataaaaatcaacaagaaagagacagtctggtggtggtagtagtttcaagaaagtgctttctcttcgactgcaatttcttcctttctatgaacatttatttattgatgccctgtaatgcccttcacttctttgtgcacacactgaattttaattcagtcttcacagtcctgcttaaccatcacagcttctgtgaactttttctgtatatcattttgctctcatttcaacaaaattaatcacttttgctattttatagctgtagattacatatccctcttgtactgggtctttataatattttgtactcatttggatacaaatacttctactgctataggatgggtttcccttaaagtaagtattatgcctttcttgtttatctttattattcagagcaaacatgtattttggtgaaagcaaaggcaagttaatggaactgatgtatctttaagttattgtctactgtttattttctctagttttatgttttaatgtaggctgatgttttcatttcttcctttcattaatccatttctttattactgctaaaagttaactagtatttgttgttagttttttgttttcttttgttttagagacagggtctcactatgtcactatcttgcccaggctgtactcaaactccttggttcaagccatcctcctgccttggactcccaaatagctgagactataggcatatgacactgtgcctggctgggtttttgttttgttttgttttgttttgtttttgttatttttaacatcatatgatacttgattgacttttctaaacccgtggattaatatctgcttctaaagtaaaaaattgttaaccttgttattgaaagctagaaagagaaaatgtctggcttaaaggctatcctaaatttttgaaaaattcttatgagaatataatcatctatataaagggtacatttggaaaatacaggtatatctttaagaaagattcagaatttacaagaaaaaatattgaatatgaagatgattagacaattgaacaaatatgtagataaatacatcaatttttacaaaacatgaaatagcattaaaaagagaagaatttatcactgctatcacttatcactgttgcagaggtccgattaatgcagtaagaaataggagtttaaaagttggacataaattgatcagataattattattttctgataatatttcctgtaaaatccaagataatccactgaaaatatagaaccagttgaacaatctacaaattgactggagtcaagagaaatatatataaaacagttgcattcctgttctcacaaaattactcataaaataattagaaacttctgtttcaaattgggatgtagaacagtaagaaagaacttcgctttcatggtaacaacaagaaaaccagactaaagaaatatctttttctatgagtctgtcaaggagcaagcaatgcagaaaaccctggctgaattgaattttaggaagaaataagtgcttcataggtgatcagagtgctgtggcagcttccatatctgaggctaaacacttgttcagacagcggaggagtatgctattgtagatggggagaatttttaaggtcaaggggaaaccatccacccttagacaacaatgtagcctagtaagatgaaattagatctaaaagtctaaatgccaaagcaagtagctcagccccaggttacactattatcctccacacttgaattttgctaagataaagtcagttgaagaggccctagaagtggattcctatgaaattttgccatgattggattccagaattatgaataaatttaatccaaatatgagccaaaaatatttatagtcccagccaagtcccccgctagctcaaatgaggataagatccaaaaggtggcatcaccaatggttgaaggttgagctaaacacaagtgaactaaatacaattaaagcccaacttcagttctacataagtcagtagaaatgtatccacagattgccaaattactgtaattagaaagcaaagaatttaaagcaaatattgtaaacatttaaaaaaaattaaaggtaaaattcatataatggatgaaaagataaaatattttaagagataaatgatagctctaagaagaaataaaatggaaattctagatctgaaaagtataaatttacaataaaaactttattggataagtataatagcaaattggtcagtgcagaataaaagattaatgaatttaaacacatatcattatgaagtaaccaaagaaaaatgaagagaaaaataggttaaaaaataaacagatcgataacatgtggaataatatcaggagatttaacatacatggagatgtgggttccaggaagaagaaataggcagaaaaatatttgaagaaataactgttgctaaatattcaaatttgatgatgaaacaacctaaaaatgcaagaagctcaatgaattccaagtagaataagtataatatagccacatattgtatactcacagtccgattactaaaaaaaaaagattatggaaataaaaaccttaaaatcagctagagaaaaggaaaaaggcactacatagaagaaaacaatgaaatgaatgaaggctaacatttcatcaaaaataattgaggctagaagataatacaatatctttagaaactttaaaacaccaatctcaattctatattcagtgaacgtattattcaaaaataatttgaaagacatttttagattaaagaaagagttagtatatcatgaatagtcttgcattacaagaagtgctaaaaaaagttttaggctaaaaataccaataataactcaagtgtgaggaaaaaatgaaggaaaatggaaattaaaaatgtgaataaacagaaaatattattaaaaactcttttgaagacatttgattagtgaaaacaagaaattttaaacatattctgcagtttacaacatatataaaattaaactgtataaaaaatagtacaaataattggacaatggtaaatggaagtatgttgctgtaaggatcttatatgtgaagtagtataatgttaatttgtgatagtatgtgtgttaagaatgcatatgatgatccttagagagccattttaaaaagtctaaagtctacctagggagatgaaaaaggtagcaaaatggaatgttaaggtaactcctctaatccataacaaggtagggaaggcacagcaaagaagcaaacagcaaatgcaaaaaaaaaaaagaagaagaaagtaagaaaagagagaattcaaatagcaagatggtaaaattaagttaaaaacatattaataattatgttgaatataaatgcacataacacaacaatcaaaaagaatagattattaaactggctaaataagcaagacttacaaagggtgtacaagaaacacacttcaagtataaaaacataaaaagcttaaaagtaaaaggatggaaaaaataaaccatgaaacatttatcataagaaaatggtagtggcaatatttatatcagccaaaattacctttaagaccagtaatattactaaacagacattttataatgatagtcaattgattaagaagaaattatcctaaatgtgcttatatgtagtaatagagtttcaaaatacataaagcagaagtttacaaaccaaaggacaaaatagacaaattcccttctatatttcaagatttttaaatgactttcttagtacttaataaaagaagttgataaaaatctataaaaatacagaaaaatcaaacacactatcaacaaacttcagtgacagttattgtacattctatacaaaactggaaaatagctattgtttttcaaatgtacatggaaagtatgtatatttgaaagtatgtacactacaaacattctacagctaatatgctgggccataaaagaatcttaatatatttaaaaagttgaagtcagaatatattctctgtttatatagaattaaattagaaatcagtctgaaaatgctatctggaaattttctaaatacttcaaattaaacaacacatttctaaatgccctaccaattaaggggaattttttaacaaaaaataaagtataacatgaactttttggaatgcaccccaagtaaggcctggagagaaatgtataggttaaatggttatcttagaagaaaaaagtccaagctttcctaagcttcttcttaaaacaggcaaaaaagaacaaattaagaccaaagtaataagaaatgaaaaaaattaaggcagaattggatatcaatgaaatggaaacagaaagcaaagcccagaattgatttgcaagaattatgggtgttggggaatggagagtggtaaggggagagaaggaggggggagagagaaaaggagaggaagagagagaaaaaaatattttggattaattttaaaaatctatcgatatgatttaccacattaatagaggaaatagtatagcaaaatatcatattatctcaatacagctgaaagacatttcacaaaattttatacctattcataatgaaaactttcagcaaactaagaataggagagatgaaggaccactacaaatattctacagaatacatatacatatatatatatatagtatacatatatgaaatgtacactacaaatattctacagctaatatgctgggccgtaaaacaggcaaaatatatatacaatatatatttaatatatatttattatatatacttatacatacttaatatacttatatatttatatatataaatatataaaagtgaaatagtgcatgttttgattttaagatagggatcaagttttcgttcaaactttaccagtagttctagccactgctaaaacaatacgataatataaaagtcataaatatagaaaaggaaaagaaaatgtatttgtcatcgacataattttgtatgtaaatgctttaaaaaatctttgaaaaagtgttaaaactaataaatgaacttggaaagattgcagaatacaatgttaatataaacaaaattaattgaacatactagcaataaacaatttaaacaaagttggatttaaaagaatattcaaaacatagcacttaaatttaacaaaataaatgaaaatatttgtatagccaaagctataaaacataacttagaaaaatcaatgtaaacctaaatagatgaagatttatcatgtttgtggatgaaaaacaaaatattgttaaaatagccattttcctgaagtcaatttattcatttaatgtaattccaatcaaaattccagcaagcttttttgaagaaattcccaagttgattctacaagttgaaagacctagaatatccaaaatactattgaataaagtattaaaaaaatggcaaactgagccatcttatttcaagatttaaaataaagccataataattaagacttcatagtatttgtactggcaaattaatcagaaatagactcagacttccaatgtcaattaaaatttgatagaggtaaggcagttcaatggggcgagtacaatcttttcaacaaatagtactgtatagtgtataggagtcaaaaaaaaacaataaagcttgacccctatctcacatcatgcatacaatttaatttgagatgggttcatagacctaataaataaaagctgaaattataaagcttctagaagataaatgagaaaatatcttgatcatcttggtgttggtaaagatttctcagacaaggtacaaacaaagcgctaaccattaaaaaatggtaaattcaacttcatctaaaatattaagaaaatgattgccattctaactgatgtgagatggtatctcattatggttttgatttgcatttctctgatggccagtgatgaagagcattttttcatgtgtctgttggctgcataaatgtcttcttttgagaagtatgtgttcatatccttcgcccactttttgatggggttgtttgtttctttcttgtaaatttgtttgattctggatattagccctttgtcagatgagtagattgcaaaaaatttctcccattctgtaggttgcctgttcactctgatggtagtttcttttgctgtgcagaagctctttagtttaattagatcccatttgtcaattttggcttttgttgccattgctttttgtgttttagacatgaagtccttgcccatgcctatgtcctgaatggtattgcctaggttttcttctagggtttttatgcttttaggtctaacatttaagtctttaatccatcttgaattaatttttgtataaggtgtaaggaagggatccagtttcagctttctacatatggctagccagttttcccagcaccatttatttaatagtgaatcctttccccatttcttattttcgtcaggtttgtcaaagatcagatggttgtacatatgtggcattatttctgaaggctctgttctgttccattggtctatgtccaacaatgacagactggattaagaaaatgtggtgcatatacaccatgaaatactatgcagccataaaaaatgatgagttcatgtcctttgtagggacatggatgaagctggaaaccatcattctcagcaaactatcgcaaggacaaaaaaccaaacaccgcatgttctcactcataggtgggaattgaacaatgagaacacatggacacaggaaggggaacatcacacaccagggcctgttgtggggtggggggaggagggagggaaagcatttggagatatacctaatgtaaatgatgagttaatgggtgcagcacaccaacatgacacatatatgcatatgtaacaaacctgcacgttgtgcacatgtaccctaaaacttaaagtataaaaaaaaagaatcaaaactttaaattaaaaaaaaaatgaaaaggtaagtcaaagactggattcggctaggtatatgtttaacttagagaatgccaagcagttttccaaaatgattgtttaattttgcctttacattagcatgtatgagagtttccattgcatcacctattcagcagattttggtgtttttaatttgaccaattctagtgagtatggagatgtgtctcattgtagttttaatttgcagttcctggatgaatgatgacactgaacatctttctcatgagcaaatatggttatttgcatatcagaatttttagtcaagtgattgtttagacgttttgctcattttctattgggttgcttggctttttattgagttgtaggatttttttatgtattctacatgtccattgtaagaatttaaatttctgataaaagattaaaaaaatctatagtaactttttagcagctttttcattcatactagggacttgtattacaggttccttctcttgatttggattttggaaggcaaaattttcatcagctgaaatgtattagttcttgatttctttttgttcttacaatagctttgtatggctattacttgacaatttccaatcattttgaaatgtcttacattttcctgtatctgcaataacaaagttaagttgacagggataaaggcttttggatggctttttatgtttcttagttcaagagagacacatttggtttttgaaaaatgtttgtgttgaagtctaacatacatacagaaaagtgcaaaaagtagcagtgtgcaggttgacccatttttataacccggatagccttgtgtacccagcacccacagtacaaaatagaacactactgggcccccagtgggcctgccttgtgccctttctaaatcccagccaggattacctctatccagacttctaacatcatacgtggatttttgtctagttttgaacttgatataaatgggatcatacagtatatattcctgtgtacttagtatctcttacacaatccatgtttgtgagattcatgtatatagttgttcattctcattgctatatctgttgtttgtacagttgagtgacacgtgtgtatgtttcagtttgaaggtgtaatgaaaggtcttgctgtaaacatacttgtatatcttgtgaccctatgcatttgggtggggctggatgtagatccaggagtagaacggctggatgaaaacatacatatatcaaaagatacaagggtaacttttttgtttgtttttgagacggaatctcgttctgtcgcccaggctggagtgcagtggcgcgatctccactcactgcaagctccgcctttcgggttcacaccattctcctggctcagcctcccgagtagctgggactacaggcgcccgccacgacgcccggctaatttttttgtacttttagtagagacgaggtttcgccgtgttatccaggatggtctcggtctcctgacctcgtgatccgcctgcctcggcctcccaaagtgctgggattacaggcgtgagccactgtgcccggcccacaagtataacttaataaatactgtcagtttttaaaagaggttgtacgctccaactagtagtttatgaatgttgcatgtatagatattattacattatatattataaatttaacattttactttttaatttaatattatatataaaaatatatgtaatatatacgtgtgtgtatgtgtacatacacacatatacagtagttgcacatatttggctacactttgtgtttccttttcattttagccattctaatggatatttagtggtattgcatttcattttgcatttctcagatgactaatgataccgaccatctttttcatattttttttttctggctatgtatcttggtatcagatatatgtattgcaaatatctgctttcactatgtcatttgtcttttcattctcttattcataccttttgatagccaaaagttgttaattctaacatggtctaatttatcaacttttccctttatgttatagcttcacatttatcgtttaagaattctttgcctaatccatggccccgaacgtgtatgatttttatgattaaattttaaagttgtaaacctcttacttgaaagttaaatatttccatgtagaacttggatttttcatatttttagaatgttaggccatggatgtaagtttattttacacatctcatgtataccatttgtacaaagtatgtgttccttaaatatttcctgaatgaatgaatatagagatgcatgaaatgctctattgtttaaacactagaaaccaaaacactgaactttagaacatttcctgtctcattttttgaaaatcaaagtctaaatttcagaaagtgagaaaagtataattttcacttgtctgcccattttagtcagtgtttcagcttaacacaaacattaaaagcaaaaatattttggcactgctgggctctgatccacagctcttcttattcctgggcccaggatgataacacattcatgaggcagaggggaagacaagttcaactacacagctgtattaaaatttctgctctcctgcgcacaccgcatgtccactttcatttctttggccaacacaagtcacatcactaagcctaagtcaatagttgggaatctgtaaatacataatcttcttataggaaaagagagtgttaataattttgaatagttatgcatgttaccattctgtctcacggtagagtcagtaatgttttctttaaaatgttttatatgttaatcaaaatattatgtttatatttaaatgtattcttttttatttagttcatttaaagaattgattacatgatttcagcatttggctcaaaagatagaatttatctatatctatggcaataattaattgtcaagaatatgtttcagtgaacgtgtgcatttttaattttgtcatagattttgcacaaaagacattcattatttattttggcagtgtaaagagaaaaatgagaagattaaattatttggaaaatgctgtgggaaagtctcacatacaccatcaattccaattgcctttttttatactatagcttcccttcttaagaaattttccttgatctgtgtaaaatattatattttagttgcactagcagtgcattttctcatataagcataaaacttgaaaattaaataatatattttagaaaaacacacgaacttgcatatttcttaaatagtgcataatttttatgagattcccacgtatatcttgtctaaatattcctgtaattcttactgatttattttcattcatcagatttctcttgaattaaagacaagtagttgtcttcccagattgagcaattattgatatcttccaacacccaattccttgtttttattctcctctctactgccacatagatgactccaacacactggtagagagttttgctctcttcatgttccaaattatagcatttttgtgaaataacctcaagctgagtaattttataggaataggttttattataatatatgataccaaatatcacataaaaagtggtgacagaaagataagatttctcaagtagtgttactctgaaccataaggagagaagcttaagagaagaaaagagttggtagaaatataattgttctctgctcaggttgtagaccagactctacgtctatgtttctgctggtagatgcttccttttatctccctggtctaccctgataattaatttatatgtctcccatttctttctctatcagatttttctaattcgtgttctgtacccaccttctactcattcatttcctcagtccttatcacccagcagtcaagagtctgtccattctacttaactgaaaaagattatgtcattaccagctccgtaagtttttcttcagttctaattattctggacctattggaagtgtttacacagttaactaaccttgcctccttaaagttccctcctatctagatttccattttacaatattatcttgatctaactttattcttgcccttgtttttttcttttctgaaatgtggacatttccattaaaggctcttgttctttttctacaatctgtctcttagacatggcttttgataggtgattgccaatgtattttcctagcatcgtcttctcttctaagatttagtttctcatttccaaatggcaggcagagttttctgcatcataagttcagtatgcctaaaactaaagataattcctaaccccagatttccttccttatctgacatttctatttctgttattaatgccccattttcctcaataattggtgaaaagaatggaccattttgccccacaccatcacctcatatcaatatgtcttaatgtgcctttcctggtatgtatagagtttatcctttcaattactaattcagttacttgtctgtccttgtcttattctcccaaagcacagcactcacctcttttctgtgtagctaagttacgtctcctccctacatttcatcatgaattttgttgccttagtctcaattttgaaaatcctattcctgctctccactcaaattttaatttcttccattaatttatgggatatgtttcaaatgggtggctcaatcatttcagtgcacttaataggggagatgagagagaacaatacatctagtagcaggagtccaagtgtgtttgactactgaaaagcaatttgttggggcaaacaattctattctgtggagtggaagagttgccaggaaggactgcatcctgaatctgacagcaagaacacaacattcaagcaggccagagtaagagaagaagagagtgtgtaacaatgagaaataaaaatcactaggacaagtttgttgaaaatgaccaagagcataaaacgtagaagatggagatgcagaagtcaagaaggccaggataaatttgatttgccttcttggaaagtctaaagcttgtatcctaaacttaacctttgctgtgactaaaggaatagcactctaaaaatgacttagaacacagcattctttttcatctttgtcttctatacaaacttctcaagccagattgtacagatgtggtctcacctatttctccagatttatctaactgtctccctcacaaccagccttcctcaaactttccatacctctaggactttgtacaattcccgccaaatccttcatattctctaaaaacaagctgaagtactatattatctaaaactgtcctcaatttcttttaatcaggtattttgtatacatccctataccatttatcacattgcattacatttttttaattgtcttttttctcaactagaactcaatgtcagttatgggcttattagtttttcttctttgctgtgtatcggagtactattcaacaaatgttagtgttccatagatgtatgttgaaaaaacgacagtccaatgttcaccaaatgatatctgctttcctgccttcaaatcctagctaaagtttttctcttcagacatggcttctggagtagttgctgtctattgaaactgagttaaccaccacccacctatgtagggcttttggttaccagcccagcctgaaggaagatctccttcctttaaatttttattatcctgcctgactgtatttttactcaaatcagtattcattcattattcactattgtgttcttgagatgttatttgattttcatatatggtcttgagctcttatttgattccacaggataatttgttaagacatatacatttaatattttcaactaaactggaaattccttgaaaacagagattgtgtctcttaccagttttaatgcattaagcaaaaagccttatacagggcaagagctccacagtatgtgttgagtacgtgggatactgagtagagtggagatggggccatgtaatggtaggactggagatggggccatgtaatggtagggggaaggcatcattcataggactggagatggggccatgtaacggtagggggaaggcatcattcataggactggagatggggccatgtaatggtagggcgaaggcatcattcatagggctggagatggggacatgtaaaggtaggggggaggcatcattcataggactggagatggggccatgtaatggtaggggggtgacatcattcatagggctggagatggggacatgtaatggtagggagaaggcatcattcatagggctgttgcatattgcccctgcttcctaagctgtggaaatttctatgagaaaagagcattgtatatcctatgatatgcagggctagtatgtgctctgaagggtcagtaaagatcccaaaattctgaaggctgcaaaccatttggttatagggtggtgtttcaggaaattacctctataggcctcttcatggcaggtctttccaatattaacttctattactgaaccgattctttaaacttcataaatattttaagcaagaccctctgtgtttctttcactcttgtcaaaaacccatttatttttatgactctctgataatgttttcacattgatactctgagtatccaattttgggttgacaatatgtctttttgggttgatgagttttgcataaatttaaacttcattatatattgattagcaggaatgtgggcataagattccaagtactgaatggcatttaaaatgggatatatttaaaaccaaatggcctagaccatgcgagtatattgctgtgtataatttcctgactgtactcactacatcataaataataatgaaagtaaatgtacatttatcagaaagaatcaacaaaaccccagcactgatttgctgatcacacttgtcttaccaggcattaaggccagctttcgaacaaaagtgcctgaaggtttgattgtctttgcagcatcacctggcaatcaggaagagtattttgcacttcagttgaagaagggacgtctttattttctttttgatcctcaggtaaatgagaaatcataaactttaatatttttaagaatttagtaggtgcctggtactgaggtaaatgcttctgttttcacactgaatcttcattcaaaccttgtaaggtaagtactattattatccccattttgccaatcaagaaaatgaaacttacaaaagtaatgtgacttgccctcagctaaaatagcggagctaacttttaaaccatcatggtctgactgagaatctgtgggcttaacaaccaaaatgccaccttataatgaagattaaaacttttaaataaatttaaagagatctatttttatttttcttagtagcaaaaaatcatgtccccttttcttccttccctgtctttcttttttcattgtttcaccagcaaatatttaagtggctatcgggtactatggtactgggcgttgcagactaccatagtttcaaagttaaatatgaccatgcccctgcaaaggatacagtaaaataatcaatttaaaattcttataaattgtatcaaaataaagatttaggattctatgtattataggaacataaaataaagaaataaattgttttctgagttgtcaattttctctggaaatgtgatatttaactgagatacaaatcaatgaagaaaagttggtcaggacaagattatatgtctgtatttgagggtgtatatttcaggtggggcagtacaggggagattctgatctccacctgggaaggtgctgagcataaagtttccaggcaaagtgagcagcaaatattaaggaaatagcaaatattaagtgcctgaggtggacgagaacatggcacattcagtacactgagatgaatctcttatggctgggaacagagacaaagggaaaggtggtagattgaaaagctgggtagaaaccaagtcatttaagaccttgtaagcaaatgtgaggatatgaatttttcctaagggcagtgagaaagcactgaacagttgtcttcacttgagttgaacaaatatcagtgagcatttgatattaggtattgtattaagcatgtgagatgagtaagagaaatgagtaagactaagtaaaatatattagctttccattttctcagttcttcaacttaaaactgatgatctaaatcacacgttatgcttgacaaataaatgttttacattttattggtaaagcagacacaacgttcaccctctgtatccaagttgcgtctaggatcatggactgagtgatctgactgaggatctcagcctcatgaaccctggagatccattgaccttagagagaaaaggcagggcctattgtaccaagtgtatctgaggaccctgccagactcaaaaagcaggccaaagtcctcctgctttatgaagctgggagagccgcacagtggccactcgaaggaccagggacagaaaggctccctcctcatgacttgacagggctctgctaactccctggctggtgcacagcaggtcctcagacacaaagatttctgagcgtcccctagtaatgcagcttcttaaaggatgccagcaggtgggcagtgagtaagcaaaaggaaatagcatcacacctaagcagatcctgcagccagagggaaaggaagaagcagcagctatcgcagaaggcaagacagatggcaactgaaaaaaatttttaaaaaatcagctgaagttgattcaattacataatggaagatattattttttatttgaaaactttaagtagattaattagaggagagacactgagcctcagattagtaggtcagaagattaagttgaagaaatctctcaaaatacataaaaatgtgacaaaaacaagaaagttagatactactactgtcactaagaagcgaatcggaaggagaacaaaaagcacatgctcaagaaaaagagggataacataaaatgatgaaacaaaaaataggagagaatatctgatttaagagggaatttagtataaatccattgaaaagactcatcaatttcctgtcaagattaagcaaaactaatacttctatgagacctctttgtgccaggcattattctaagtggtctctctatacatcagtttgtacacttacatacacacatatgcctatacacacacacacacacacacacacctacacacgcacataaactcatttgaacttttcaacaactctgtgaggtagatactcttcatattcccattttacaggtgaggaatctgggccacaggtaagttaattttccccaagtcacaacactaataagtgaccaagccaggttataaacacaagcaattgagctccaaagaccatgattttagctacagtgctatactgcttttcaacatgaaagaaagatggttgttgatatccataaattcagaaaaaaaaaatccatctctgcaccaggttggaaagaaatatttcagtaagtaatctagccaaaaggaaaaataacagagtcagaaatataaaaagaagaagcatcagtgaataataaatctagtaatattaagttatgcctaaatatttaatgatagagtgactagaactctgttttacagtgccaaatgagaatctttgaaatagaagagaagtatagcaaaggcaagaaaaaaaacgtgaataatcatttgttgctaaaattagtaagatttgaaggagaggaaagatgagtgaattaaaagttctgaagataccagcttagtggcggggtgtgggtggaataagggaatagattatactgacgttttgttttcgttaaataaatagggcaaatgtttgatttcaaatgttatagaaaaataagttactactaataaaaagtgctcttcaggacatccaaattaacaaggttaaaaaggacagcaaatgctaagttaaaaaatcaacaaaaatcagaaaaagaaaggggagagtacagtaaaatagaagactgtcaatgagaaagaaaaatctggctctgctttttccccttcaacctgttagtatctggagatatttaagaagaagccagatggaaaaaaaactaatcacaggaccacttgtttatagagctttaaagtatacaaagtgagttcctgttaatgatctcatttcattcttgaagtagccccttgaggttgattttgttttcatccctgctttagatgaagtggcttaactacggtcatagagtggtttagggatagaactagcactgaattcaattatttgaatagcactgaattattttattcaatgaaactttgctaagaatttattggacttcacagttatgcactgggaacacagaaatgaacagaatgacactcattggaattctggccattggttgttcatcacagattttgagtatttatagccacccccctaccaaacatgggacagtcattggagaattaatccaaaaatgatttccccaagtctgaagcatgactgccatctcttttgacatgtggtgttgctatttctaaaggatgcgataccttaagactctgtaggataggagggtaaaggggtcaaactgcttaacggagaatggctgccaggaaactcatctggcaggtctagttgttttcatatcctttacggtgatcacctggacaggctggtgcaaagcgtggtaacagaattcagggaaacattcacagggcatttgcccatcatttccgcccccttacccttctcattcacacaattgcttagagtactcgtcactgctattagttttcccagttgctctgtccctaccctgtatagccaaaccctaagctgtatacatagtccgcaggtgccagccaagtattaataaaattgttaaagccactgggcgtggtggctcatgcctgtaatcctagcactttgggaggctgaggcgggtggatcacaaggtcaggagttcaagaccagcctggctaagatggtgaaaccccgtttctactaaaaatacaaaacttagctgggcgtggtggcaggtgcctgtaatccccgctactcgggagactgaggcagagaattgcttgaacccgggaggcagaggttacagtgagccgagactgagccactgcactccaacctgggtgacagagtgagaccttgtctcaaaaaaaaaaaaattgttaaagccaagttgggggctaaagggagtgaggaaggtttaatgatgtctagtaagtaaatttttatctgaaataatctctctccataaggtaaaactgcttgagttttcaggaaagtgacaattattttttaaaatacaagatatgggttgagcaggatggccttaggatctagctgagaaaatgtaatcagatgcattacactatgtgctcacgggccatgaggctctctatatatgaaacaacgagcttatgctagcaaggactgtgtccttccttacttccaatgaatttatactctaaaacaggtactaaacatattttctaaatttataatgaaagccccactcatttttagacaaagaagtgttaaaactgagggatggtgaaaattttgaatactcttctcttatttgctctctttttccaaagtaatatcaatgcagcttcttgtatgaagttagagctactctgggttttaaaaagtatagaagtttatttcatatgccttctattggcattacatttatttatattttaaatactttgggtaccactttaagtcagtttttctcctttaatctttaaatgcggacgagattatctagtgaatactttttatactcatcacacaagtaattatgtacttagtgtgtctgtcttatcagactgtatgatccagtgagggcaaagtctatgaatcttttgcccacaggtacttcctcaggacttagaacagtctttggaacatagtagatgcccagtaaataaatgaccattgacatattacctggctgattgactcaataactgttggtaggatactactactcataactgaagaaaattatccatttttctggcttacaacgtctagctttgtaatgattacacagatattttgtgatgtttgttttatttttttttattttgaaaaaattagagaaaaagtcttgctgttttgctcaggttggtcccgaactcctggcctcaagcaatcctcccaccttggcctctcaaagtgctaggattacagacatgagacaccatgcccagccttgttcaaatttgtctgtttttcagataatttgatttttatcaggaaaaaacgagatgcttatttttaaattgtttttactgaattcattcaaaatagccaaattttgaattatgaagagaatttcaaggaattttaaagtagttatctagcacatatttataaaataacttgaagtcattgtgtactttgctctttttaaaatatcttaataaaattgagtattaaattccttacaaaacaatttaatacaacgtagaggctatagatataaaaatgtatttggtttgtcatccaactatccgaagcattctattgaataaatgtttagggaaagggagattcttcatagtacataaaattggaaatgtgtttgtatattacaaactgggcacttgccattgttaaaagatacaataaagaaaagttaactgcaacttttaattacagtttttattgttatctccaacaattttctataattttcccattcttcacttaattaaattcaattttgaatatacttgatcagataatattttagtgaccagtaatgatctatgtttatcccttaaatattctatgttcagtgacattaacaggaaattcacatcatattctgggcttacttggaaggaagctgtgaaaatgaaagctttaaaacaattctgaatagcatctattgaatgtgtctgatatgttccaaatagaaagaacaacatgcataatatgacaccagaagtcatcacagaattgttctttcaacattgatggggggaagtaatcttaaaatagtcttcaaaaaatgatattctaaattgctgtaagtataaagtgagtttgtcatgctgaggctgtaggtaatgtacttgaatttgtctccaataaacttgatttctgatgtagagaactattaatgcttcagattgttgccaaacaaaatatgaagaaccacttattcagacacctgatctttagaatgcagcatcgtttgtaacaattttaacgctaactaagtacactttgatgagacagcatttaataaaatgctcattaatttcatcattagcaagggtatgctaagaagtaagccagtttcttatgtcacgcccaattagcatcccatgctagtaatcccattagtattgttgaattcactaatggaaaaactaatgggcatgctaccagggcacattaattgggcacgacaccagttctggttttaattattaaactacgataatgaaatgtgtgtttgtaaaatattaaaatgttgaaatagggttgaagaaaataaaagggtgtgtagacaaaacagatataaggaaagtcaacctacaaaaatacgaagactagaacttgccagatggtcatgtttctagctgatggagttgtctgtaaaagttgggatattgtccatgtgagagacaacccactcatactcatgggaaattaaaagctttttttttttttttttttactttggtaacatgaaattctgtatgtcatacatgttgtcgagctctttatgaggcccgacaggaaccaattaaatgtgtagagtggacatgttgtatcactgaagccatttcagagaaagataaacagaaatcatactaaagatggtatgattaacattgtatgtttttcaatatacatcttcagcaccattacatcaaacaattatctattttctctttttgaaaaaaacagcatagcaaaattattagagtttggtgaaattttctggtaattaagtgttttggtaatattttacccaatctaatttttttaatttttaaagattttattagaatgagctttattcttgttaagtaaatcaactttattaagaagaaaattcattcccatttagaagttgtaatttcttttttatttttatttaatagtagtactagtagctgttggtgacaaagttgggatatctttcacttagtcttattcacttaacacagaaaatgttactataggtaaccaaggctactataacatactggaaaattgtttacttttctcgaaagtagtgagatggcaggtgtttcttctatttctctttctcagtttttttttttattcttacctcctatttgctaaactctgttcttaatatctgccatttcctatgtcttatcacttaggaacatgtttttaactattatatgattaccttagccagaactataattattggattttaactacaaagcattgtgtactacatttaactccacccttatgtttaatgtatcacaactggctagtttttaaggtgaatgtcattcccatttgttattgataattttgtgaagataagagtgacttgtctgacatctctctatcttcagaactcattttgagtggtattttatgagttttaaatttttctcttctttttcatatttatgccatgaaacttaaagtctaaaattttagaatagaaaattctttacccttctgatgaatagctatattcatcagaaaatgcaagtgactttgtaagaaattcttactgcaaaggtgagacctttacagatctgtacactgtggtgcacagggaagtattaatacatcacaggaaagccagaatgatgctagacatcagctttaattttgagttctgtttgaaatgtatgcatgcttgtatcaggatcataatcttgaaacttgtaaattggtttataacaaatatgtgtgtgtttatttgtagatatgcatgtataaacatttatttattcattcattcccttaaggggtcaccagtggaagtaactacaactaatgatcatggcaaacaatatagtgatggaaaatggcatgaaataattgctattaggcatcaggcttttggccaaatcactctggatgggatatatacaggtaagtactttttgatatgtataaatagccctgttgatatgttggtgttgccatacttttctgttgtttatattcctacattcttatttcaccataatttctactcaattccatatatattgctgttgaatttgcctttgggatgctcctaaaaggatgaagtctggcaaccagtttttcatccatgaaggtctttggtaaagaaaaaaataacaatgaagtcacctatgtcttttacagttctttacaattcgtgtggacctttagttatgttctgtcatcttacttttgacttccaaaaaacacatacagtagaggaaagcagtttttgtctgcatttggagatgaggaaaccaaggctgagaaaaaagtaaatattttttcctaacttacacagttgagaggaagcattcttgggacacacatcctgttttttcacatttaagtttagtttttgctccagcctaccctatctgccacatttatgtaattataacatgatcactgtacctgtataatgatgcaggcttttattaaattattcaggaaatatctaattttaatcagtacctattatgttccaggtattgttctaggtgctctggatacaaggagcaaagagaatactgtaaaacttacattttatgggaggaatggggcagcaaaatacagaataaataaatttaaacaaatatcaagtggtgataaattctgagaatgaaaaagccagatgagagggaaagttgtgtgtgtatgtgcgtgtgtgtgttaagaaaggtctctctgatgaggtgacatttgagcagagacctaaagggacaaaggggaaaccatgtaaatatccaggaagaggatgctttgggttgcgaggacagcaagtatcagggccctgaagtgagagcacactacatgtggcatgtcaaggaccaacaagaaggccagtgtgggaaagagggtgtaaaagagctaatgacatgacataaggtcacagaggccattagggatcagattatatgggaccttgtgggcttttactttgaaagaaggaaactgttgaaggattttgagggaagaatgacataatatgacggctttctttaaaaggatcacactagctgctctgttgagaataaattttaaggggaatgagggtgaaggcatggagatcagttaataggcttctgcaataactctgtaataattcagacaagaaatcatggagacctgaaccagggtgataattgaagatataataagaagtattcagattctggttatactgtgaatgtcaaattaacaggatttggtgatgagattgaggcagaataggggttggtaaactatcaccatgggctaaatctagctcatgcctgtttttataaagttttattggagcacaactacacccattcatttacgtattatctatggctgcttgagtctgaatagtctacaaagacactgtctggcctttgacagagtttactggcccttaatgtcgagcaagcctgtcaggtttgggtctcaggcaactggaagaatgtagctgccaaaaccagggagtgcatgactgtgggagaagcaggtttggggagagacattcaaagttcagttgagaacatgttaaggctgagatttctaagacacccaaggggagatatcaggcaggctgctcaagaaacaagtctagttctgaagtcagaacttccagcaaaggatggtattgaaagccaagggaacagatgtaagtagggctaattggagtggattgggctctggaaaaacaaacacaaataactttgcctcttctctcaaagaaggtgggcattagaaatatgaacagggatttccattgttatgccacacagtcagagacccaggttcccctggcctttggccctggcagttcgtactggaacccagcccactattcatccctctagagtacttagggggtgcctatgggtagagaaaggaagaggcctgagaggcaggcggtctggatcattccaacatcatgatgctgggatgttgaggaagagccagtgaagaaaagtaatgaacaggcaatgaggagagaggaaaaccaagagagtggtatcccaaaggctggtgaaggattttattatttgctgagctagtaaaactagagtatcctggtgaaggtgtatttctcatctcctcttctctaggttcctctgccatcctgaatggtagtactgttattggagataacacaggagtctttctgggagggctcccgcgaagttataccatcctcaggaaggatcctggtgagtttagtaaggtatattatatgttgtcatccaaacttagaatagaacctgtttacattattttaaagtaagaataagtattatgttctacctcatgctatattttctatattaatgtgccaaaaatttcctttaggtctcttttttttaaaggaaccatgtattccatatgacttgtatttatattgttagtactcggttcttgatatataaaaggaattcattaaaacttttgctgaaatgaattataataatttcagtcaaaggtatgttattttaggacctatgcatagttttttctaagattttaaattgaatgtgaaacaacacagaaatggaaaactatgagcttgatttatactctaaatagggtgaagaacattccctgaatactatgtgataggcactaaaccaatccctagatattcatagatgaataaaatgtggtctttatcacaatagaggtcacaggcgtataaacagacaattccagcctaatgccattagtgctataattgagctatagacaaagtgattctcatatttttagaacaagagcataagaacatattctaaaatgaaactaattaaaatgaacatgaatggaattaaccttagataggaaaaaaaatcacccttcaaacgcaatgctaatattctaggattgtttcccaagtcctcattaagaatcacagggtgcctcccaagtctctcccaggaagttaaaatataactacataaatattacaaataagctagaacccagataagtataatttgttcatgggttgcagtctcagggaatcatgatgaagatcaaaaggaatagaaagtgttcatcaaatttaggagaaggatatagttgaatcctcaaggctgattatagttacctcctcagaaatgtctctagattagagagggttttcattcaactacttgagactgacagagaagtccctctaaaacacacacacacacacacacacacacacacactcacgtacacagcctttgttttttgcccttctgggaaatagtatcttcaggtactaggagagaataccctgatactaagtacccttcctgtagaggacacatctccattatgaataaccaattttactttgtctatgtaaattggccttataaaactctcataaactcaaagctgaaaactaagctttgcccccataggaaaggaggtggctgtgtgaaattcgacctcagtgcaccttctcctcctcttgatttttttttcttgctttttctctaattctctcatttgcacattttctctctcaaccttctgttatcaccctattcactgtatttataaagccacctctacctggtctggagagttccacattcaagatcaacactatatacatttcccaaaatatgaagccaaattattgatttacttcagtaacagactggttcatagatgaggaatctaaactgtaaactatatattaaatagaaacactcccttccaatctaacttttaaaattatagtactttatttttgaggctagtggcagatgaattttctgtgttagttgaaaaggcaatattcttgctactgcaaaaccaaggtttctgcataaacatctgtttctgcagatatgatgggtttgaaccagcactaaacattataattgctatcatttactatagctgatggtgtggtgtttacatgaatcattaagaggcttgcagtaaataggtagtgagagctagtgcctatttctttgactttaatggcacataaaattaattgcttgaaaataatctttcaaaatatatatttcttgatatctataaactcctgcagagataatccaaaaaggttttgtgggctgtctcaaggatgtacattttatgaagaattacaatccgtcagctatttgggaacctctggattggcagagttctgaagaacaaatcaacgtgtataacagctgggagggatgtcccgcttcattaaatgagggagctcagttcctaggagcaggtaatgctctaaaaaagacatgagtgttcacttaaaatctatgttctatcctttgtataatttaatctctcctgtttgattaacttgacctcatatgaacctagtatcacagaaatacttagttattccaatggtgcacacaaatatattcttgacatctgaatatgcaatataaattataagactcataagtatacatccatgtatgatatctctggtaactcatgcagttcttgatttacatatgttagcatcaccaatgtccatttgcaaatcagttgtttggaaactagaatgcagttagagaggtgtacttagaatgcactcagaaagatgtttcaaagagttttgtttactaggttaatccacaaatgcctatttatctcattatatagaagaacaatgttcttagttaattctcggctaggtaatgggttaagtaggccattgagagagaactggagactagaaccaccatccctgccattgctcaaaaggctacaatgaaaggggaggtgtaagtgtctgtagcttacccctgacatgcatgcacattgagtctctgcctgatcagagcagagacttccacccaggggaaggggagagggatgatggtggcttggtgcacccggcttgttcatcaaataaaagcccatcactgcctcctatatttacagctaagttggttggttattaagttgcttaaactgccttcagcacaaaaaggcatatgatattaataatataatctacacattttttattctgttttcatcaaggtcattctgagtttcttttagtcaatgcaaactacttattgttaatatttatctgaaacagtaataatcttacatgatacagacaacacatgatttagagagcaaatttcttcctgttaaaaagtataatatatatcaaagtctttcttagtatatcaaggtctttctgtcacttctgtgcaattacaaaaggaatttcttaacattgatttgcatcttcttttgtgagatttactcagtggcagactgtgtcctagagtttcttagcacccttacaatgctggcaatattgtgttacacatgctaatatgtacatatttttatctttaaagggttcctggaacttcatccatatatgtttcatggtggaatgaactttgagatttcctttaagttcagaactgaccaattaaatggattgcttcttttcgtttataacaaagatggacctgattttcttgctgtatgtgaattaatttgattaaaattactttaaaatataggacccaactttaaaataaataaaccatgtgttggcattacacttaattggggtttctttacaaattcacatttgttcattttttttcccagtcatttttagttttgaagtcctgtgaaacattttgtattttattatcctagtaattttttaagatgacaattgtaacaattataattttaagaaaacagactagatataaggaattaagaaaattcaatttagtatcttaagatatgaaaaacactatttccctcattatcttttgatatgagttttgaaagcatatatattatatatttttcatatgacatatagataatcaagtataataatatagtgaacactcctggacctaccaccacgcctgataactgaatattatcatttttggtctatctataaagtctttcctatcttgtttccatctcctttcagatgtcataggtaatcagaattttgtatttgttattcacatgcatttttatagtttgaacacctaatgaatgcctacaaattcttgcttttgaaatttataaaattggttttatactctctctttagcactcaacattgtttctgagtcatttatgtgtccacataggtatacattttcttggctgtgtagtatttctcttctcttaccaatgatgtattggttgttcccatgttttgcttcaatgaataagactgctataaacatttttatacatttctctaaatacaatgggcaactgtaactgcttttccttgtctttaatcattagtttgataccactgttaaatacgttattaaaattttaattcttaaaagttgttttaaagaactagcatagaaacaggagaaaaatatgaacatcttacccttagattcttgatttctaggcaaatagacaaatacaagtcttggcttttaagagtctaagatacgttcatctttttttttttttttttaacattcctagcatacacaatgccaatattgctaagaagggaaatggaaatttatcccttcatagtatttattaaaatttctgcttttttaaatatttgtttgtcctcttgtgtattgttggcttctttctctgaaacgtaatgtctatgaatcttctctgaaatgtaatgtctatgaatcttcgctgaaacgtaatgtctatgaatctaaggaccttggttctcttctttatagttgtatcttcagtgcctaagccttagcaattatcatgttaatcaatattgttgaatgaatgaatgagtgaacatgtgaatgagctcatgctgtggtgaccttcactgagcatcgttgagtcatctacatgtgcatacactgtggaggatacaaagatgtttaccatttggctcctcctcttgaggaccatatgcctgagctggaggtctatatgccctactatgccatgcttccaccctccaccttcctctattcattgctttgttactgtattaaataatactgttaactttaagtaactcttactaaaaaaaaaaaattaaaaaattaaggctgggtgcagtggctcacccctataattccagcacttttagaggcctgggattataggagggtagcttgaggccagtagttcgagaccagcctgggcaatatagtgagaccctttttctatgaaaataaaaataaaaataaaaagttagccagacactgtagctagttccagctactcgggaagctgaggcaagaggattgctgaagactgggagtcgaaggctgcagtgacctgtgattgcacctctgcactccagcctgggcaagagagctctgtctcaaaacaaacaaaacaaaaaaaaatcaatacacttagataaatatatacggagtgcctattatgtgcttggctttcttttaacacttcccatgcaactgaaaggaagcagtctttcataaaacttaacattacggtctgccatatctgaggactgaggctgctcccagattacccctcaacaactctttctattatactgacttatttcaatatgcatggttatcccctggaacttgataaactcagaatgtttccattgctgaaaccttgaatctcaaaatataacctcatatccctctagctctctcagtctctctcattaagttcaccaacgcattgacaccattggctattagcccactttctagttaacttacttgctccttacctgagccactataatgtatttcttcaaccatatttctaccaataccctgatcttgtgtcttgtattgggcttcacaaaccttgatccatcagtccagccacctcgcttttcagttctagtagctagattgctaaacactataggaaaactaatacgggtatgagaacttgttttgagctctccaattcttttattaaacagtatctattgtttacaggattttctaatatattttagatgtagaaagtgaaagaaaaataatcttaggatctagaaacactataacctgaatgtcttcaggtagtctcacactctcctgataaaaacaagcatgcatattcaactttcagtctctctatcaacttgaccgtatttgagccaagccagatttcactctctaccgactcaggggaacaaatgaacaattaccatgcttacaaccaaagaaaatatgtctaccgtcatcctagattctatcccttcctctgtaagaacttgttctacagtctcccctctttgtatgttcaactgttccctctcaattggctcttttccctcaatatatggaatgattgaaatttattttccttagtgttttttcttttgtctgtgaagcctcctccactgtacttttccttaccttcatggtcaagtgcattgaaagtggttacttttgttattgccactttttcatctcacttcagtccctaaaatgactgtacattaggttcctgcccctaccacacctttctacaaaatcacttttctaaagtggtcaatgacccccacatttcctagcccaatgatttttatttcttatattttttgtcctttttctgtcattctgtttttttcttattcttccctactgattttccaaaatactagtttctcctgatttcattaagttctcttagcttctttaaggagatcattgtcacttaaaagaactattttctactacaagacccttaaaacattggtcttgctgaggacactaatcttttcccttttctctcagtctttttacactcactgaataatcttatttattttgtcatgtattttctcctttttgctgggccatccccaaactgtgtatctttatgtttgacttcctcaaaaagagtttcatctggatgttttataggcatttcaaactcaatatatttaaaatgaactcacccctcctccttgtcaacaacaacagtcagcatttctttcaaatgcttttcataacgtgatgatggcagaacaccctcctagttacccaaaaaagatgagatgtgttcttaatttctttttaattcatctaactcatttaccttttttaccaggtcctaatgagttgcttttacaaatacttctaagattgagtcttctctttcatcagcatcatcattatccttattttaatgactctcaatatgttttcacaattaaatggatttcctaatgcatttcctgaattctagtcgagattttgttttcaatgtgtacttcttatgtctggtaggctaagcttttagtgcaaggtaatactgggaagaatatgagttttggtttcagacagacaccaaacattctttccataccagaccctcctatcactgaaagtcctttaaaatctggcttctacatagctggcaagacactacctcacctcccacctccatatgtaccctttgtcttagctaagttggtgcctttctctgaacctgatgtcctcatgtcatgcatattagtccccctccttgggggaccctccatgaatcttatatagtttctaaaaccttgctttaaacctttcccaatttccagggagcaaaaagccttctctgttctctgctttcactttactcctttcttgtcttgattgttgtattgctcccacatgtttgcctctgctactagacagtatgactcttaggagcagtgtttaccttagagcagcaggtatatggcacattgtaagagactcgatatttattgaataagtggttagacaaatgaaaaattgcttacctgaggtccttcctgaagatgatgcttttatggaaaaattcataatttttatctggcatgatttaatttgttttactcgacacaattgatctcaagattttaaatatcatatggttactgatatggtttctaacaaagtaaaaatatattaggtaaaataattatcatgagacattttgaaggaaaacctatgaacttattttttactatgaaaatttgggtgaaatatgttcacattagaaaatggtacagtcatctaatagaatacacatagaagcaattatgttagttaaagatttagaataaaaccgaaatattgaatcaaaatatgtcttacatatttgaaattgagttcactagccagttaaaataagcttaatcaagcttgacatttcattttcttattgtcttgccatattttcccccaaattaaattgatatatgaagtagtattttctcattttctaaaaattcaaagagtcatagttcaaagtgttctgttctcttcagtcattcagtcacttatgcaggggtttaatcttctaactatgttgcagcaaaagtaaaccttaggtctacataacatcgcatcacatcctataatcattagtaggtatgaatttgtttgcatcaatacaacattcttcatgtcaactataagctagaaaagtgtttcctatgttcctaagcagaaacttagggtagagtgacacatttctatagagtgctttcagggaactgttttgcttttcttcaagaaattgactttctgctctctcccaaactgcccttctgcagcctttttatatacctactttcttttttaatataaaatacagatggagctgaaaagtggaatattgaccttccggttaaataccagtcttgcctttacacaagtggatctattgctggggctatcctattgtaatggaaagtggaataaagtcattattaaaaaggaaggctctttcatatcagcaagtgtgaatggactgatgaagcatgcatcggagtccggagaccagccactggtggtgaattcaccagtttatgtgggaggaatcccacaggaactgctgaactcttatcaacatttgtgtttggaacaaggtaagttccatctggaggaattcacaaatccatacagccctggtgctaacagtttttggtggttctgtgtttcaagagatagcaatagactcaggctaaaagcagcacccaacagcatctctttttctggagaaatttaaaccttaaaaactaatgaaaacactttttcaaagagttttgtgtgttacccttaacaatgtgccatcatttataatcagcatatttatttcaatatgtcctcagtaaatagtaattaatatacatattattattaatgtgacatataattatatatgtggtacataattatatatataaattactatttactgaataaatatcaaaataaatatgttgattataaataaggtaactgaggtgcttcccaaagatgatatttatatggaaaaattagtaatttatatatttatttaaatatgtaatgcaattatatgtgagatacataattatataagaaatatatgtgtgtacatacataattatatatataattatatatataatgcatataaatgtatttcctcatatgttggataatgatcattatctgtatttacagatgaaaaaataaattaagttggtatgcataactagtaaaaaatatcaatgcaattcattgccttttctttctttgacataaatgctaattgtctccatagtttttcagtagagctttcatgtggaaaaaaaatgtggggtgtatgtggttgacttccaaacatacttgtgaaaatctatatattgtagattattaataactataagagaaaggaaaagtgcattatttacaatttaggtgagaagttaactcatagacgtttgaatgtaatcagagaaataattaatttgaaaaggctaacaatatctgtgtatcatttcttgtggcagtcatggttctgagagcttacatgagaataggtgagtcaattattcataacaagtgtgttaggcattattatttatatcctcattacagatgaggaaactgaagagcagagaggaaggtaactttcccaaggtcacatggctagtaagcagatagcaagacactaagtctctcaggcagcctgttataaagtcaactctcctttttacagtcaatgctctcttttatgggcattggtcaatgctcctttgtaaagtggggaaagcatagtaacttccagcataggaccaagcaccctcccacgtgtgaaaaaggtcctttacgtatttcaaaatctacataccctgaatggttaaaattttcatgaggcaatctttgcctatttggtaagtacataaagatttaaatgcctttgaatagaaaatatatggcaagctcttaggagacttttagaagggtagtagtaaggagttaatgaataactggggtgtaagacagtaatgacattttcaaggcacttaagatgtaacagcagctaaaaatattacattcatataagagcttctccaggttttcaggtttctgaggttagaaagaacttgaaaacccttcgtatgagtgagattacttaatcctgtttgcttctgggaaaaaaaaaataaaaacaagaaacaaaaaccctgcatgtacagccttgttctttgaattacccctaaacccattactattgatggtcctaaagacgtggctaaaaccaaaattgtaagataataacagaagtttaaaacatcaccatagacccaaagggaataattttacctacacactatgactaagtctgtgatactggaagatattttattagtgagtaatattaaatttttattactgtagtatcatccatatcagtggtctcaaaacactgaaaaaatattgacgtatggtagctggaacgtagaagtcaaaattagccattatttttactattcaagatacattgacatcacctggaatggttattaaaaatacagatgttagggacccctgtcccctaagattctgactcagatgccttgagagacactgatctatataaatagctgcatgttttatacggtgatcagggagactagtcacaatacagaggtgcagcatgtatgtagtcaattgcaattaaaacaaatcatgttcatttaatgtatttctttcaacccactatcaattgtcttaaaaacgtttttccttttctctgcttcttaattagcaccttttttttttcatcagaagctctattttgtggtcatattagtgctattttttttttaatctactaacgttgcaatcttcctccgaaccagatacaagactaattttctttcttgttttgaaaatgctgggcaacataatttgctgaagatgtgccagctcagatgatgagagtttatcttcttagaatgatcaatgaggataatcacttacatctaggttgggcatgactgggtctggcatgtggtctcacaggcaatgctctgcccaaacccctccatggagagggagagagtgggggctcaaatttagcaggcctgccaagccaagcactctgcagcagtactgccttccctagaggaagggctaatgtttttctgattagtcatcttagagctctgggccgccttttaggcatttagaggcccaggggtggtggtgtggatggggatttttttggattctcacaagggtagtggagtaagaaaagaaagcatttccactcctctcgcaaacatcccctttctccttttgttgtcctcgcatctcattcaaatgttttaggtctggggagcatttctggtggtacagagttgaaagcacgggacaaccttaactgaactctttggttgccactggaaggaccctgcactagagctcagcagcttcaagagctcagcagtctccaaggccagaggccagaggaccatttccttaggaggattagtgcttacaaacttcattttataactaactctctaggcctttttcttcatctccaaaatgaagaaagatgtatctccctgggctttcccaaattgaaaatttcatcttgtgaattaatttttatgatgttttttgctaaatttttaattttttaaacattatggtaaaatatatgtaacatgaaatttaccattgtaaccatttttaaatgtacagtttagtggcattaggtacattcacattgttttgcagatatcaccaccatccctctgaagaactcttttcatcctgcaaagctaaaactatgtacccctcaaaaaataatgtagcatttcttataacagcacttgtttgccaagctgccctttcactgttctgattttgttggtagggaagttagggtacagagaattttgataatacagttatgtgccatcagaaaattactactgataaatacattaaaattcttagcttctgaattttccagccaatgatttcatattgagcttcattgctttcaattcaattcacccaacttattgagtgtctactgtgtgtttaagatagactagcagtattgatcagtcaggactaaaaaaatgtggataatagtaaaagacatttaaaaggaaataggctgcaacttaatgtgttagaaggcataataagacatcatatgaatgctgaggagaacaatatggtcattgttactattaacttattttactgttatgcatttcattatattttatttccatttcctgctgctgtgctttaatcttgaaaagagctgatcatgtgtttgaggcctttcaaactttacagtgttttgttcggagagagagagagagagagagagagaacatgcacgctacagcaatctcaaactcggtcctgtttgtcccaatttcgtgcagttttctgcgcagagtactgccagacttcactgagctgatctctgttttcacaaaatagcatgtaattcaaagccactgctattccctggctaactggatgccttttttgtttgctgtctaacaaaaaagtggtgaatactctaaattcatttcatccgcattctctgttaaacttcacagaatggtactgcgcagtgggtgttctaaggtcacctgtgcagaatgcacattccatgaaatctcatggtgttgctattgccaacagtgaaggctggcccctgtcatgctaatggggatgtaaaactggtgaccattttgtatgttcaagattatggaactctgtgaaaaatgatagagcatagtgacagctcttctgtaggctgatgtaactcgggctaaattctatacctctgaagtgatcattatgccattcatggcaatatttcaggactaatatattttgaaattatgttctctctcctggtattctacataaaatgctcagagtgtatttttccccaatgagcttactgaataatcatgctaattcaaatattattttttggcacttaaaactgacttatatagtaacttaatctttcagaattaagagacatggggctatccccctaccataatatgaagttgcctaaattttattttatgggaagaagcggaatttagaaaatgtgggcctaaggaggtaaaataaatgctttttcagtaccaaaagttaaattagaattatccattaatgtgttttccaaataacagaactatatttctttgcaacaaattagcttgttaaaaagtaggaggcataaaaggttttccaaggaagactcgaaagtctagcaattgtatctaaccaccccccttcctcaaaatgtagtgctgcagaggacaaaaatgattggtaattaatgactcaagccctttatgcgatactaatcccttactatttgctaggtttcggtggttgcatgaaggatgttaaatttacacggggtgctgtcgttaacttggcatctgtgtccagcggtgctgtcagagtcaatctggatggatgcctatcaactgacagtgctgttaactgcaggggaaatgactccatcctggtttaccagggaaaagagcagagtgtttacgagggtggtctccagccttttacaggtaatgtggaggtcctctaaattaaatgttacatgtctcttattcatccccctttccctccctgccagcccctcattaatctatatgagtattattttaatcttgctgcatcttatttccatttaagaatacctgtatcgagtgatagcctcgcatgaaggaggttcagtatatagtgattggagtcgaggacgtacaacaggagcaggtaaatacttatcttcaaatgcatatgtgcacacacacacatgcatgtatttgtgcatttatataaaaggaaggactattaccctgaagcagtaatatttttgtagtcttctgacagagcatgccttggtttgaaaatacatctgtcaatggctaaaatgcttagtagatcagtgcttttcatttaccaagaattcactaaatacttgctcagacttgatcctttcctcttaggatgcagaagtaaggaaagttcaggttgtcttaaggatgtaatagtcccacctacctaacatgtctaaggataggtaacctttacagatggtgtagatagcaagaagctgaagtcagggattaggattatccttggctgggagtggcaccttcttgactttctcacagaaagcacatttgaaacctgcaactggttggaatcaggggtgtctatgacatcattgcagatgtttgccccgttgttgactattagaatcttagaatgactctcccaagagagaaattgctgattggtttaatatattttgaattggaaaagaaccaactaggagacagtatacattagacctaatctcagacaactgacttgttttgtacttctgactggccacaaaatcttttcccaaaataccaccacaggaaggcattcagcacaaagagttttgtgaatcagtgacattctactattttgggtcaaatatttgtcaggaaactgaacacatctccagatgattgccacttatgtctcagcaaggaagtttattcagcgagtatcaatttgtctaaagacgtgtttccatcaaggtattctcttatacttaatcaacagtaggttactatcccaggcatcctttgaggaatcttcttaatctaaaatataattaaatactgagatgagcaactaagaataattttcaagactctctacctacatattttccagaagaggacaacttgacacttttccaggatgatttaaattatcacctatttataggcaagacaatgagctgaacgatctcttaaaattcttttcaacttcagagctaagagaaagctccaatataaaatactcacttgttactgacatgttctctgctcctatttcacactcttctactttattaacaaatataaagcccgctttgagtataattcagcaacattaataggcgtctggaaagcacattgcttacttagcttaatagtccccattttgagtactactgagaaagtacacaaatagagctctgaatttatagcaatgatctgaccacagccctatgccataaattcatatttacaatctgaccacaacactgagcagctacatgctcccaagggttggagaataattgcactatttaattatttttgagtcagttttgctctgtcccttatgagaagaccatctgttagactgtactgtactttgccctgtaccacatttccgaactaataaaatcagcgtcactcccattgtccctttccttgcaactcgatcttgtggcctgtgtgttttctataggtgtctgtagtgttttaactgctcagagagtggttctcccctttggtgtttcctcttatcttttatgttcactttgtttcccttaaagctgtcctactttattggtctggacagtaaagtcggagaggaggagatttgatgtggaaaaaccagagtgatcctccatcgacagggctcaggagtccatgagcagctagagcaggtctctcatccatcatcctgccacggagttccttgggctctttctttgtgtccccagtgcactcagctgtgatgaagtttttactgatcagaactgtagaaatgtctaataaatagttaaaggtaatagattttttaaattagggggctcagcttgtaagtaaggttttgcagttcttttaaacttcctcattttgtgatattattttgaaatattctgcagaacaagactttgaaaatgactttgtagaatctcaaaggcaccagctcctttaccccacccccacccccaaaaactgcaactaagaatatattccatatatcatatctggtagaactttgctttttaaaaattaattagaaaaacaattgcatttggaaaatgggtctaggcattcaagtacaacacaatcacatttgtgattttttttttggctaatacatcgaagatataaaagtgtcaaactactatgtataataacagtctaattatcttgcttcaaagggggtacatcattatattgcttgaacttgttatctgcctaccatccacctccttctttatgagtgatgtttaaacatgtctgatacattaaatgtttttggaaaacctggactagacttgaaagaatgttatgtcgatggagttttgatggttttgaaatatcgcttaaactgaatggctcaagatgtgcagtcatattaaatcaatgctgaaaagttacaactctaataaattgtatttatgctaatggttgagtctgatttactgcggccattaaaagtgaagaataggagcaatagtcttctcagaactgccattttccctattttctcttttattccttcacagctccacaaagtgtgccaactccctcaagagtccgcagcttaaatggatacagcattgaggtgacctgggatgaacctgttgtcagaggtgtaattgagaagtacattctgaaagcctatagtgaggacagcacccgtccaccccgcatgccctctgccagtgctgaatttgtcaatacaagcaacctcacaggtaaatgcaatcctttaacagagtagaccctattaacttcctttttgtttgcattttaaataaaaatcttctgcaaatgttttttagaaaaatgtattaaatatacatgtattttacctgattaaaaacaacacccatctaaagtagtggaagcctgcatctacctaggataaaaaggataattctacaatgcgcatgggctctcatggataattttattctaaggtagatattctctccatcccccaaagattacatcataggtggctatagccctttaacaccttatagacatcttttggaaatcctatgtataaatacttatttcacaaagcaaaaatttactctttgggactagccccagttcataccactattatttattgtaaaattgctgattaaacctaattatctcaaggtggaggagtcttagagccccagttagttggactggcaaatcagtgaatcgatttctcacagtgtggtgtgccatgaagaatgattataatgaaatatactcatacacaccactaacacatctcacactcaaattcatgcgtgtgtattaagagcatttttcagcttcatgaaatattaaagcacatttaaagggagagtttaatttaagcctttgataaaagggaagtaaatgtgtcaaatttgacagaaaaaaaacattttcctctatcaaaaaatcctataacgtgaaccatcagaatggacgttagaaaagccttaaatattttcccaacaaacctgttggtcaattccctcaagactttacttccttctttagacactttggaatgcacagcccaaatatactaccaacttttagcaaaagaaaaacaaattcacacccttcacttctttcctattttaccctccttatcaaagcccagcctgagtaagcccacagcttgccttttcacaggttgcatatggcagctacatgggctggaaaataccaagtagtttattgctaaaaatgctcaaccccactttcagatgagcactcagtaatgacaccaaccctactgtatttccagaatagctccttcccccattctcctcattaaatattttatatttttccaaactatacacgttacctccctttctcatcccactcagctgacagcgttctattttagattatattagacaccatagaaaaaacaatttattttataggatttctattactttcttactaccaaatgtacatattaattgcatttttctgcctgatggagttgttattaggggttggatgaatgaatgcatgctaaaacacataaaaccattttgatatacaggaggtgtgtgctatgctataattttattttcattattatttttaattttcacgctttttttcctttctgttttacaaagcttctcttatcctatcaaaaatagaaatcttcacaagtcctctggaccctgactctttctgtttcttcagagatattactgatagcttatcgtcctctcacttatatttttaacgcctctgtctgctgcagtagagtatggcccaaggaccagcattactagcttcacttgggaacttattactaatgcacattctcctgccctgcccaccccacacccgccaaatcagacactctgcagtgtggctcagcagtccttgttttaacaagcccccagatacatctgatgtatgccagcatttgagaaccactgactgggtggattcttcccagggtcattcaaactcttttatctcccattgttaaaaaccaacacactaacccaaaccaatcacaaaaatcttaattctgtccaaactcccagctattgctccctctctcctcctctcggccttcgtctagcatgaagtatctaagctcattttgtcctcacttaactggcttctgctcattactttcgtgacgagcaccaaaaactgccatgtttacataggcaaaaaacacttgacactctatgtcttcaccactcttcagcattctccacagtaactctttcatcatttctagaaatatttcttcacttctgtgacttttctgcttacctcctggttctccaggggccctgttctcagtgtcctttgctcacttcttctaaagtgtgacaaaatattgaagagtctcaggatttagaactgggccgtcttctctttctctttcatttttttctggcttgctccagaagccttattgactctcataacatcaaataccagatagatgctgctattgactcctaattgtacatcccacctagacatccaaatgcctgcatccaataggcgtttggacacaatgacatttccaactggatgtctctcaccttctacccataccaaacctcaactcttgcttctcctgcattctcatagatacctccagccacccagtcaatacaatttgagagttactctggacttttcacctccttcacacctcatatccacagttgtcattctatttttcaaaatatgtgttaaggtcatccatttctcctctaatctactggccagcccaaactactaccatctttttcctggacaactgcaatacttaccttcatctttttcatagccttttttttttttttctctccctggccgtgagtgtattctacagagcatccaacatcatgtccctctcctcaaaaactttctttcttttttttttaattatactttaagttctgggatacatgtgcagaatgtgcaggcttgttacataggtatacatgtgccagggtggcttgctgcccccatcaacccggcatctacattaggtatttctcctaatgctatctctcccctacacacaccctccaccgctcgacaggccccgatatgtgatgttcccctccctatgtccatgtgttctcattgttcaattcccacttatgagtgagaactcgcagtgtttggttttctgttcctgtgttagtttgctgagaatgatggcttctagcttcatccatgttcctgcacttcctctctcacaatcacactttgtctgggtctccccctacttccagggtttccaacaattaccgttgtaattaatataatttaaagaaatttgtatgtaaatccttaggagaattcctgacaatgatgatataataaatccctagcagtggaataactgcatcgaaggcttttaagacattgtatagtcttgaactttgaagtcagacattgatataaatctctgctatataccttccctgtggataagttccacatccttctggatcctaaagtcctaacctatgaaatgggagagtgatatttacctcagaagaatattgaaaatattaagtgatatgatattctagctctaaccctttttagctgtgtagcttggacaaatcaataaacctctgtttgctttaaaatccttctaggtaaataagaatgagatacaactacatgcctcccagggcagctgtggggattaaacgaattcatatgtatgtaaagcacatagcacagtgcttgacatgtggcatgcactgtatcaaagttacctacaggatatctgtaaagtgtgtaacattatgcttaatgcttggtaatttctcaagaaatggatagcaattattattattattattactattattatttaatgaagtctcactctgtcgcccaggctgtagtgcagtggcgcaatctctgctcactgcaagctccgcctcccaggtttacgccattctcttgcctcagcctccccagtagctgggactacagacctccacgcccgggtaattttttttgtatttttagtggagacagggtttcaccatgttagccaggatggtctcgatttcctgacctcgtgattcacccaccttggcctcccaaagtgctgggattacaggcgtgagccacagtgcccggccaggatagcaatttttacactgcccaaaaagctgtacaaattatgcttccaccagcaagcagaatgcaagattgtgcatttcattttatctagccaacaccaaggtttacacttgaaaaaaattgcaaatttaaaaggcaaaatatatcagaatattgttttagtttgtatttatgtgattactagagagattagttttttaatatttattgaccatttctacttcttttatgatgtgcctaggtaggtccattgttttttattttttattttattttatttttttattttttgagacagggtctcactctgtcacccaggttggagtgcagtggtgcaatctcagctcactgcaaactctgcctcctgagttcaagagattttcctgccttggcctcccaagtagctgggatttcaggtgtgcatcaccacgccagggtaacttttgtatttttagtagagatggagtttcaccatgttggccaggctggtctcgaactcctgacctcaggtgatccaccagccttggcctcccaaagttctgggattacaggcatgagccactgcacccagctgcattgctaatttttctattgaatgattcacattttctcattaaagtttttctctgcatatgaagaataatatacatgtttatctcatctaatgcaactcccccagttttgtcattttttaaaaaattttgatttgcatttttgtgtagagatttaaaaaatattttatgtagttaatataacacccttaaaatgttcaatattctatgtgtgattttttaaaaatatatattccccatttagggttgattattgtttatgttagatataccatattgataacatataatgcatattcctcaaaatagtaattctaaggttaggataagaacaaatcagaaactggatgcagggaggcttttcaaattaaatcagcctctcccaagattctgaaggataccttcttgaaggcgagatcccacagattgtaaaccaatgtagggcagtactggatgttactcaaaaggcatgtcatacatggtagtgatgtatagggagaagaaaatcagaaaactgttgagcaattgttatttatttttatatatcaaatttgtcacaaactaagggaagagttaactatgttaactatgcatgcagttttgtcaatttctctgagatttttttgtttgaattttttgagtttttattacttttacacttattatttatgttttaaccttcaaagtctcattgctttaggtacagtcatgcattgctaaaggatggatatgttctgagaaatgtgtcattaggagatttcatcaccttgcaatgtgcttacataaacctagatgacatagcctactccacacctaggctagatggtgtagcctattgttcctgggctgcaaacctgcacagcatgttactctattgaatagtgtagggaactataactcaatggtaagtatttgtgtatctaaacagatcaaaacacagaaaaggtatagtaaaaacactgcatggtaatcttatgggaccaccatcctatatgttgtctgttgttgaccaaaacattatgtagcacatgaccacatggcagcaacttggctaacatcctttaattcaacattgttttcttataagtttgatgagaaaattaaaaaaaaaaaaacaatccctagcaagggccactctctgcatggaattttcacattttccccatgtttttgtgggttttctctgggtactccagtttcctctcacatcccaaaggttttccccttacatgaattgagttgtctacgtgaccccagagtgagtgagtgcaggtgtgtatgagtatgccctgtgatggtatggtggcctgtccagggctgattcctaccttgagccctgagctgccaggatgggctccagccacccacaaccctaaagtggaataagcagattggaaaataaatgaatgagtaaatagaaatcattataaaataaaaattcataaagtctatgataatcatacagatgcacagcaataaacaattcagtatgacagggctcagcaagctgcccagtctgtgattgctggggtttgaacttcatgctggtaggcggtgctccttacaatgttcacttggaaagcatttattccttgatttatataccacaccactgtcactcactgattcaccaaaacttgagtaaatcattatttcgttttgattaatcttttgtaaatgcatgtatagcacacattcatttcaatgtttaatattagtagtctatagaaatttggtgatgttttgtgaccagaaatatgccataggatcttaattcttttttacatcaattagcctgtgggaaaattgggtttgttgtatatcatttcacttaaaagtgatagtttacaaaaaattccaatgacattaagtgaagacttctatatatctctgcagttttagttttatctttcacttgagattctctgtatttaagtacgggagtcactcattcatacttgtttttataattgatataattggtcttctctctgccatcatgttttatgctttccagttttattatttcttgttttttagtgattttttcactacatttcttgccaatgtgtactatgaattctttgattttttttctttcaaggagtttgcttctctcaatgctaaattgagtcatcaaggacataggtagaaggtaatcttaaagactaagaagaactccagtattgccaggtggacttttcattgtgaagactcaggataatgaggagggaatgtgaattgagagtcaccaaagccagcttggataattatcaaagtcagagaatttcccagtaaacaaaaggaatactaggaagtgagatggaaggagctgataaagcagagagccagaaagctggatttggtggagacgttaggggtgcagagattgttttgaggcagctgttttgccagttggttgagaaaccaaggtaccaaaagagagaaaaatcggtgaagcctatataaacagttttgctattgagcagttttgctactgatcttgaaaataacccttatttagcatttctgaggtgacttttgttgagattttaatatttaagttaattttggttgttagagtcatatttaaataaaataattctgacactgaatgtacaaggcaatttcgctttattagttagcgtagggttctttaccaattaagtttaaaaaatgctaatcagaaaatgtgctgttttatttcattaattttttgttgtataataagctcttttattcttcagatttgggtctttcttcagcttggaaaatttgccattgtgtttatgatcattacttctggtgagaaatagcaattttcaatattgtatatttcttcctaggttgtcttcctcattttagtagttcagaacacggcttgtagagtcaaatcaatctaaggtcaaattccgcctatgccactttttagctgtgtgatctcagacaaatttaaaaacatatccttacattggagtttcctcattcataaattggggatgaaaaccttatttatattatggaactgctataaagattaaaatgagttatgtaaaatattttgctcagaaacaggcacatagtgagtgttcaatgaattcatagttacctttataatctctgaattacagtttctgatttctgggttattgtcccataattgtttttatttccattttctgatttttgcactgttgattctgctctttgaaacttctaagatgatttttaattcttctagttcagtctttgatatgatctgcctttttcctcatctagcttgctttgatttctgcctgcctcttgaaattctcaatttttgtcttcatctcttgtttactgcttaccttctgtctcttacttagtggattccaagttattttagatctaattaatggcatgcaactcgtgatttttaaattttacaagtttcttgaattaaatcctccccagaatatgacaatcttccataatttgagggctatatccttatccttctttcaagttacaatttttccatcagctaaatgtcctcccccaaactcaactccatagtttagttggctcatctctaatataaccttctgactgggtgtttgcatgggaaaattaaactgttttcaaatcatcttactgggcatccagttgctgttaataaaagcctttgctaagatgatgacagggttagtggggtaagtttgcattagccgcgcagccaccctacagtttcagcttctttcttcccagtgtttggtagagtaggagtgctgagagcttgctggcattttgcttccagtttaagtttgggtttgcctaggactttccttctaacagtccattgtctctgcctggtctcgttttaggtatttataaaactttggtcgtttcactgggattcttacaaggtggtagttcaaaactatagctgtatactgagtcaactggggagctttaaaaaatatactgatggctgtgtgccccacatgcaaaatgtctgattaaattggcctggaatgtggcctggacatttgtacttttaaattatctcaggtaattctgctgtacagccagcacagggaaactctatttaaaggaggagtttgtcaccagtgatcacatttaaattttatccagatattcttataactttcatttccccactgaaactcaaaaatgttaggaaataaaaaactaaatgtatataaaaaataataagctattaaaagtaaatagaaaatactagcaaaggaatatcataagatgacaaaaattaagtgtaatagttattgggaagtgggattttatgttcagacttacaaaaagcagaaggtaaaagcaaagaaaattattaaaaatgaatatcaactaagataactgaagaaaacagaatagtgaagcagaatatttaccattcatgaatttgtctatcagaggattaaatgagataaatcccagttgcaatggagagtccaagggttaacaggcccgctcaggagcaaatgggcccctttgggccacagggtctagattctgtgccctcccaaggccaaggttcagagcaaggagttctttaaggttcattccctcagccagagcctcagggtagaaaacccttcagttatcactcctgtgtatctttagatttgttgaaagggctccaattaactctgggtagcttttgctgatttttcctgcagccctgttaacatgcaaagctgcagcccagagagacaggactggcgtttcccctcaaactgaggactgctcagaaactgacttcataatttgatttgaaattatttcaagaatgaatggattcaagacttcgcacatatacgaattattttttccgtaaggtgtttaaacatgtaaacttaattatcagcataattactacagcacctggcatcaagtgttacagatataattggtgtatacaaaatattttctcaattttattgttgcattacattgagctaaagtctaggggttatattgcttcttcaggtaaaatgataaataatagtaatatttcttactatttgctatagtttggcaaatgaatcaataatgataagaataatcttccagatgactcacatatatctacatttatgtaaagaaaaagacattttaatttataacacaaataataatatagcttttgccactaaaattgtttcagtctttacatacaatggacttaatttttttacctgaatgaagtgggtttcatactgaaaatctgcctctaatttttgcctcttttacatggctactgtaataattagtgactctcaattctactggtcataaggtgattctcagattacttataaaatgcagatttgggggtcactcacacatgattctgtacatctgggctagtatttagcaatttgcattttacctaatgctccaattgtatttttggaaggtttatgaaccacatattgaaagacactagtgtagaggagtggtcagcttagactggaatactttcacctgctaggcttgcaactatccctgctttattcctgcttctggttctgactgtgttagctttgctgccagaaaaatgccaaggcaagtgaagaaagagaggcagtgtcagtaggacccctgaaccccagtaggactcctgaacttctgaaaattcccagaagaaagaaagtaagaattggggatcttgataacatggattctgattcactaggtctgggaatatggtgttagattctgcatttccaaccagccccctcccactctgtcatgccccatatagaaaggcaaggagctcactatttatatgggaaatggaaaacaacaacaacaacaacaaagaaaaaacagtaaaataaaacaaaacccaattctcaattacaagatgccccttaggttcatataaaagtgagagcagtataattcaatgtaggaattatcattgcaatgtcttggtagagccttgcctgcatgcatttaagttacaaacattcaactacatattttggaaatgggtaagggatggaggaaaaagtaaaaaagcaaaaattaaacaaaacaaaaacctataaaaatagtgtcataggcaaaggatgctatccagtatggaaaatgtcaacatctgttagctggaaagaatgtttgaataattttagggtttcccagtcattgacaaagaagtgatactcattgtttgggtgtctacaaaaagaatgaagacttcagagccctgaagaatcattgatttctgaagagttagaggcatacacaaaaccaaatgtactatactttatgggccatataaagagttgtcaagggaactttaaatcacgttatttttgccttatgcctgattttggaacttaaactcagctatgcagagtatcatcagtaagattaaattaaattaaaatgctactctatatatgtatgtatatgtgtatgttatgtacgttcatatattatataaatatgctctctctctatatatgtattctctctatatatatgtaaccatacttacctgagaagtctgcagagaaatgactgtaattcaacgccgtgaaatttttttttctattcaactgaaagttcttactccatagttgctaaaactgcctatggtactctctgtgcacccatgctatttcttcaatagacaataagctcctggaggacaagtttcatgtttcatatttattttaagcctcgttcactaccttgctcaaggtaagtgattaatatacttatcttaaaagaatgaatgaaggaatctttcaattagcaaatgtagctttctgctactaaccccatagttaacctaatgttaatatttttttgtgctgagttggactgagtattgaactactagtccttactaaagtctcctcagtcttttatcaacagttctttaattttatagaagaatgcacagagctatcacaacttaaatgtatatttggaacttaatacacatttcccaatagaaaaaaaatatgttggtagggtaagactaataaataactaataaagactaattccaaaacttagacctcagaatagaacccaaccactacatatttgaaatgaaaaataatggaagccaatactgctgcaatgctgataattataaagaacagaaaatattcatttatttaaaaaagtgatctaccacgttccatgctagtgctaggccctatcattgtaacatgatttttataacactaaaatatagcccaagcactctctctgaagtataagattatgtagacaatgaaagttttatagggaaaacctaacagagatgggtttatcatttttaattcattatttcacttgagatactgagaacctaaaataatagcgatgaagtttttctctcactggtaataggtgtccacagtaagtcaatgcagaggcgggatgttcataggcgagacccacacacttcatctttttgctgtgtcatccttatggacaaggcttctacctcatagttcaagatgactgcttgagctcctgccatccagtctgattttcacccaacaggaagaaataatggttaaagaatactcacattcactttaaagacatattttagaagttgttcctccacctctggttatcttgcgtggccagaacttagtcacatggctgtacctagcttcagggaatgttgaaaaatgctgtctttattccaagtagccacttgcccaggtaaaaagtgtttttattttactgaggaaaaggagtataatacataataaggagcaattagtaatctttgccacaataggaaatcgtcagaagtaaataaaaagtaattctttttgttggtgttattaaagataaaagccagtttttatagtagaccataaattaatattccaatatttgtagtttattacgaacttttttttttaatttgagatggaatcttgctctgttgccgaggctggagtgcattggcaccatctcagctcactgcaacctgcgccgcccgggttcaagcaattctcctgtctcagcttcccaagtagctgggactacaggtgcatgccaacacatctgttttttgttttttgttttttttgtttttgtttttgttgttggtatttttagtagagatgggatttcactatattggtcaggctgatctcaaactcctgacctcaggtgatccacctgcttcagcctcccaaagtgctggcattacaggctacaaaatatttctttaaatgtaaatcttgaaagaaactggtctgaaaaaattcacaggacgaaaatatggcctatgacataaatagtaaaaatagaaatgatgtaatgttcctgcttagctaatgtagaaagatttcattaggtaatgcagtgttgatgagttaatagctttgtctaactctcctgaatacataatgtgcctgaactactggtacattgtgaaatcttcagagagagttgttttttaaaaaaaaaagtttttcattttattttatgcaataagaattgacaccaaaggatttgcatttctttttggtaacatgttgagccgtagttaaaaatgatgaaaatatataacttttgttctacagtgataatcaactaggcatgtccacaatgcttataaacattcaatacaaatacttcaaggttatcaatcatagttgataaagaagaagaatgcacagccagacttttctgttttctaccttttatgatcattttatatttgtgttatatttggaacaaattaaaagggttatatgtataataaacaaaggtccaatattgaacccaatctctctctctcacacacacacacacacacacaaatgcacacatagaatttcttataaatcagtcatttttgtaaaggaatattacaggcatacaaacttgctcattttggaggacaagacttctaatttctgtttgtaagcaataggtgtcagtaataaatttgaacctcttaacacattttaaggtgcattttaaataagatattttatagtaaaaagtgtgctattattgtttttaattaccatttttcaacacttttttcttgtttgtggaactggagcttaggtcaaatgggaggagtaatgatcttggggtcagaatacaggttctaatattggctctactgctttttagctgtctggacttgagcaccatacagtacactcactccaaaagcagcctcctctgtacaatggaataacaatatcagaggcttgtagcaggggaccttggacactgatcataagggatgactttcatttctctttcttttcttttcctcttgtctccttgcctgtctctctgcttagtcaggtccagtgttttcttgaagagtttcagtaatttcagtgtgagacctttatgtaaggtaaagagttaacacaagcacgtggcttcaaacttattggcaaattagaataaaaatggcaaagactctgtagttcttaccacaaaggcattgattaaaaatttgaggttagaggtaaacctgctgagagaatcttaactggataatactttgaggtcaattaaaatcactgtttaaaccgtcctctaagactgggattagaccacatattttataaagaaataaagaataatgtttttcctgtttgtaagaatcaacatctgcatagtctttgataggtatatgatattctatgctctctaccaaaagttttaaacaaggtcaaaaaacccatttgaaggaaattaaatgtaagaaaaattagttttgaagtttccaagggattaccttaggtttgggttaagtgtatttattgttccaccttttgggtaaaatgcaaattgactttccctttgtaaatattagaagtccttatttttattgaaaatattatccaaaaacaacaataacaaatcccaccctcctgggctaagaaccagaggagaagcatcctggatatgtttccagatctctattagatagttaagttttcatccatatttaacaaatgtcattattcagtttcatgggatcactgtgtcaaaatgtctgtgttagaactttattttcagaggttcctttaagtggtcaggaagcatggcatattggattgattactctctttaatccatccactgggttggtttgggatgtatacttaaaaattagattttatcagcactgcagcgggatcctcagccagaagtctcttcttctgccctccttcccctagccagttttcttttaaaaagtgggctcttccattatgtctccaggtagcagtagcagctctgcctgtgtggcatcccttaccagatggccctcttaataaatgtcttgctcttgcccaccctcactttcttgatccaaatgtgaaatgccagcaaataaataagagcattgtactctgatgagttctcttgagatgggggaaaaccctggggagaggaagctagaaacagcttttctgtttgctgtgactgctcctaattactggccagtagtagaagatatcatttagatgcagtagaatataaagataaagaaaaaaaaatgagagataaattctccatgttatcccaaatgcctttgctaacgtggaaatactcttggattgttggagtgcatttgaaatattgtgcatgatccttacaaggggacccctgactttggactcagggtagacagttgctgcatgcagatttcaccgccagactaaaagtgcaacggaaatgagtgggtgatgagagcagagcagccagttctttaattgaattaaaagctgggtgacatcaatgcagacacctgtccaattacagacaggccaaggtgtttaccattgctgtacaagcgattcgaagatgacagaaatctttccgcccacagattaacataatgaaggagaacagattacagtggatgccggccaaacaccttggttggcagctgggggtggggtgggggagggaggaggagtctgctgaagtatgtaagtagaaacggagtccttttttcttctctgaaatatgctcggctttaaaaaggatccattttgctttgtgtcttaggctcggtttccaggcagagcatttatacttgtctgcatttagtcagaggagttaatcataaaatttcaacgtgaaagcagactcctctgttgttttgctgcttctcagcatacggtgtcccattagaggtgcaaaagcttgcagagctggtgtcagctccacaatgattttgtcttaggtcgtcaggctgcctccaattattaatatttttctttggctcctttgaaacttgaggttacagcaaaggaaagagagtgttggagataataatgtatcagtcaaaagaaacaatgtctgtcactttgcttgttccctggaaggggcgtggtgggagtcaggctctcctatagtgagagaaatagccgagtggagctaacagtctgcaaaatcttaattttcagtcacccgtcaagtgctaacttttggtaaaccatactaatagctgctgggatagaggataaggaaagcagtaaaaggctatgccctctgtgttcaaggaattcccaaatcactgtgaaggacttctaagttgcaagttctctaggccaatgctcttcccctctgttaagtggaaaccctgagtgcacagagtttggagccatatgcagtaggcctcttaacctatctacggtgatgagtttccttcccttaaatcaagtccctgccccctgatctttcagcttgggctttctgcacccactgtggcccacaggacttcaattcaaagggaatctacttacttgacttcaaactcccttggtgtggcatgtcaggatttctcaatgttaggcattaatgcaaaatgcattatcgcttagcagtgagagttatggtcctgctggtgccaatgattttaatccggatacccacgctcctgtgtttcatgggatactaacacttttaagacatcaataatgcttactttatgcttattgaatgtttcttcagcttgccctcttccattacctagagggactagcaggtttcctgacatgattgggaccattttctgatttcacagagtttgtggctgaaaggcagtttgcgaggtcatctggcctgccttgtaatagggacactctcaaaaaaaaaaaaaaaaaaaagacttctctgggatgtgtcccaaacaaagagattcacaaccaaaccaattttaaagttctccctttcaggatatacttcttcagtataaaaaccccaagtgtcacaagtatcataaaaggcaactaccgcattttctatttttgggctttctgtctaggattcctttagatatgtcaattctctatttcccagtattctttttaatataataccaaaatatatatttaaattaaatttaggcttcctattatcttgaactggtaagtctgaatcttataaatgtcattgtctacttggcccgtatgcaaacattcttctttatgtatcaatctgttactgtaagaattcttctagttccaatattttcttatgttagaaaccttgtaaaaatcagttgtattctatagcaccttttccagacgcatatagcggaaacattgataaatgctttttgatgatgatatatcttcagagtaacactgtattttccagagagtacctaatctaagtagaaccctgacacttaaagcaaagccattaggataaccactcaatgatctcaaaggatatatccacaatctacatagtcttggagagaatgtgttactctctttctttggccatggcacaacttttcaacttgaatccatcctggtgaacactacttactgagaatcaaaggagataaaccacgtgtctccaacaataaaatgaccttgtcttgattccaagtgaatgaagaccacatatttgaccagccccttgcccttgcataacccttaatttttaacctgacaggaggagaaagcacagtgaaccattatagtgttcttcttcctgaagtaggtaattctaactgcctttaaggaaaattatcagttggtttgacaaactttgtctctgacacacagcatgatgaacaagattccctactggaaatagaaaagaaatggcactccagccttagaaaatgcagcacattttttgaaagtgtgatttacaagccatctaaaaccttccatctttgatccaaagttggcaagaaccaaaacatcagctttcttctttttctttctttttttttttttttcctttgttttctatttttcagctctcatttctcagggcttattattgtttcaccgggcttgaaatgggaaatgtgagcactttgataaatggcttgaaagatgatctagtttctctccagcatctttctttaagagtctcagggtttttctatgaaatacaatacaatttggtaaagatctctaccaaatcaaagctgaagaagcaagtttgctgagatgagcagtgcttgcttttaaggtccttaaaataaggagtggctaaaattaataaaagactctcactatacacatgttatacacaacgtaactcctttagtgaagacaagaaacattaaataaaacactaaagatcacttagtgagttgtgaactcaggatctggtttgatacaatccctctgaaagtctatagaatacccttccttataacttgatgtaacaattaaaatttcaacatttcactctagttatgatttggaaagaaatgtcttagtataaggaattttataaagccaggctgtaaaattgtacaatcatagagctgcttttatatttctcaatgataatacttcctgaatgtacaacacatcttcatgctaatgattgcagataaccaacctgtatatcagcattgtttctttttgggcatggtgttcctatgcctcagctgaagcatgctcatctatgaagggtgctgcttttcacatatgccccataggttaagtgatgataaagggaaactagcctcatattccaacatgcttttccttattgacattaggattaaaagtcttattctctgggggctgattcatttcttgttagcatggcgttatactaattcagccatgcaagtcatcttatttagaatcttacggtagtttccaacttggcaataggaaagacatggcaaatgccaaagatttgctaaagatagaatggctaaaacacattttatgatgataactttagttttgagcctggaatttgggtatcgtggtggaggcattacaaaatggaaaaatgaagcttacataattatttagaatgttgattcttggttggggcacgttgagtatgaaataccagtgggacatccaggtgtggttacatggcctgcagatagaaacccagaaccagggcttgggagagatgtgaagtctgtagatacaaatgtgatcactgaaagataaggcttaataagctagcaaaggcgagtgtttagaaaaagaaagaagcttgacaacaacccaatcttgagaaacaaaagctatttaagagactgtgagaggaacatgagtcagtaaaggaaacaaaggagttctcggtagtttaggagaacaactaaaaagttcaatgtcacagaaggaagttgagggaggataaggactgaggaagggctatttgatttggtatttaagggatcactgctgatctttaaaagatacaaagcgtcggccggccgggcacagtggctcacgcctgtaatcccagcactttgggaggccgaggcgggtggatcacgaggtcaggagatcgagaccatcctggctaacacggtgaaaccccatctctactaaaaatacaaaaaaattagccgggcgtggtggcgggcgcctgtagtcccagctactgtggaggctgaggcaggagaatggctccaacccgggaggcagagcttgcagtgagccgagatcgcaccacagcactccagcctgggcaactgagcgagactctgtctcaaaaaaaaaaaaaaaaaagaaagaaagaaagaaagaaagaaagaaagaaagaaagaaagaaaaagatacaaattgtctagtagcatgtagaggcagaaactgagttgcaatggtagcctaaattggaatggcatagctctgcactagagctcttgactggcaatactccatgtaagtattctaaagtcctgaacttgttcagtcttaatactaaccctttgaggtaagtactatattatccccatctcacatgtgaggcctgcaaggcctttccttcaagaccgagattattattatctgtttacagactaggaaactaaggcacagaagtctgaacaacttgcccatgtacatatggccaatcggcagcagatttggcatttggagccagcaatctggcttgagcatgggtgcccatttccccactactccattatgaagatgtgcatgtgataatgttagcttgcttttaagccatttggtggaaggagaaataacttcttaaaagaaagtaaactcagaacgtaggtcatgatctgggagatttaacaggaaatgacaatcgcaggggcaggaatgagagaaagcaggaggttctgacacgagagggttttgaaattagagagagctgaatttggcatgagatggtcacacatgtgtgtatattagttcgttggcttgctgtcttctttggccatgagctaagatgacggtgccaagtggatgaatattttcatgtagaagcatggcagacaggattcagtagcccacggagatgcctgggtcgttgctggaatgaagacttagagacagccctaggaactaagggcaagtgggaggtgtcaaagcaaagaactggtctttgctccatcctggcttgttgatcttttaattctttaaattttctactggggagggaaattatggaaacatgtatattaaaatttgtgtttgaatgatgaaagctgtcatcaaaattggcaccttaaagcaataatgtattctctgagcgattgaaggtttcatcaataaagagacaccacgagtggggccatctttttataaaaatagtcataatctatgtggttaggattaaagattgctctgaaaaacgtctttgcggaaaaacagtggtgagcaaaagcacaagttatattttggattttttttaattcacaggattaactaaataaggagtctctgccttgcttatgaacactagtaaacaaaatgtgttttcatttctacacatacttttaattgctgaacaaatctcatatatctaccagcaagccatgttaattcaatacttccacgtgtaacacttccgtttaagacaggtgtcttaattaaataaactaataattttgcaagtagaagtacaaaagcataattatctaatttgctaattgttcaactatgttaatttgcatacttgttagctacaacataaacaaatggtttgtatatgtatcgcctactgttaaaataatgaagccactcttgggagtagcatttttaaagtgtgttaataggtgccctataaaaaggactccttagttaaatacggttgaaaaatgctaggttaaagaaaattaaatagttttgtttctgcaggaggtctaggatcctggaatgagataatatatatcttagctattggaaacattgtgctctgcctcacgaactatatgtggaaccccctccccattttaatgggagaaacatcagatgctgtttgagagctgttttaacaataagttggtctcacaattttttctcatgagtccttccattcaacaatcagcagaaagggaggaaaatgactgaaagaggaatatgtttttgatttctgtctctggtctctttgtttttgtctctctctcttatagacacacacacagatatacacacaatgctctttattgatgcttatggtaaacacgcaaccctcttttgtccctttttattataggcatattgacaggcttgctacccttcaaaaactatgcagtaaccctaactgcttgcactttggctggctgtactgagagctcacatgcattgaacatctctactccacaagaaggtaaagtaatttcaaaggtcttgacttccacatttcagtcatgaataataaaataggagaagagctaaatgctacaaggccatttgctggcaaaccccaacctaatttgatgacaaagtgcattgccaggccataattgctccattttttgggggggtgcgaaaatgaatcaaactccataccctttaatgacatgcatctttaatagctgtaatgcagattaatgggctttttaattgctgttacattgttcatgcaagagccttgtcattaatatgaagcatctgaaagattaatgaaagcttcctcattttactatggctcagaagtaaatctagagacagtctgactaaaaagaattgattgtatggcacagtatgaaattgagaatcaaacggttgatttccatggtcttttttaactgctaaacagcagcacaggcaacaattatttcagtatgatgaaacctccaaatgccaattgaggcattattaatcactgcttagttccttccaacttaagtctcacttctgttgtacttggaacttacaaactgttggcataaattaaggtttcagaaagcatatgttaagaaggcagtgagaaagagaaaatattttagcacgccaaagtgaaagctttgctcaagcatcagaatgcatcacttcaagaaataacagctctcaaaacatttgaagcattgttacttcatatttctctattctggataagaggaattgtacatatcttatactgtctagttgaaaagttctttaggagatttaaacgcttgatctttagggaaaaagagtcagccagtctttctctctctctctttcccagtatctatatattccccccttcctcttttaaaccctttaccaagcaccacttgcactgaagatatgtaacagaaaggaagacatggacccataggatgaaaccaggacaggataaatgactttgtaaaatccttcttgtgacccttaatatgctgtattttttacctaaaccaatcagactcccctcacctgaactatgctgtcagtgacccagcctcagcattttctccatctggtctactggtaatagcactgtttttgttgtatcattgcatctgctgaggacatgattatcatcccctcttacaaggactttgaccagcctcaatatgggacaaatggccctatgttgcattattttctccgtatccactaaatcctttgtccagggtttacctggtacccttcataccaatttcaagctaagccccagagagatccctgctcttgtttatatttccttttttatttttaaagacattcccaaacttctaaatatccacgaagtaattctgaatttactaaatgatagaggagtttaggaaaatttaaaaaaaatgtttagttcttaggaccccccaattcattgacaactatataaaatacacagctctttttaaaaaaatatgcactaaagttttcatatgtaattgactaatttggttatgcgagctctggcaattcttatcattacatataggtttttaaaaatttatattatgaaccacattcaccagcattactcatctcagatcacaagctccttgaggctaggggactctatctgcttaatttgctttaataggtacagtcccacatagagattatgggttaatagtacttttggtggagtaacacaagcatcagtcaagtgaactagtgtaagtactcctcatccatcattgacacaaattctcataaatgtgggacagttatttaacactgttcctaaagcaattactgacaagctgcccacgaatcgggaatatttccatgcatgggatttcaggtttattccatgatttattggtttgggtctgaaaagtttgaattagaaaagtaaactaaaattagactctataaatcttttcttccacagccccacaagaggttcagccaccagtagccaaatcccttcccagttctttgctgctctcctggaacccacccaaaaaggcaaatggtattataactcagtactgtttatacatggatgggaggctgatctattcaggcagtgaggagaactacatagtcacaggtaagacctctagagttatcagcgaattgttatagtctatattcaaatataaacatacatatagttggctctcgatatccaggggttccatatctgcaaatttaatcaagaatgcttaggaaatatgtgaaaaaaataacaacagaacaattaaaaataatataaattctaaaaacatagtataacaactatttacatagcatttacattgtattaggtattctaaggaatctagagatgatttaaagcatacaggaggatgtggatagcctatatgcaaataatacaccacattgtaacagggacttgagcatccatgaattttggtatcagtagagggtcctggaaccaatctctcactgatattgaggagtgactgcacacacacacacacacacacacacacacacacacacacacacaccagataaatagagtctatagttatctgaaaatgtgtttttgaaattgggttgcttatttttatctcctgttaatcactccaattgtatgatcttgaaggtcatattagattcatggtgaaactgaagctaaaaaaatatggaaaagtgctcatgttacctccctccacccagggctgtcctactgtgtgttctcttctatagagcccaccaccccttacctaaatccttctagcaattacctttgctcagatgcagaggaggcctggaaatgcacaaatgtgctaagcacaaagagctcagcacatgacttctctgacttcagcagaccacaaggattgaaattgggagccagtgttttcccagtcaggctcacagtgtccagttggatcaatgacatcatcaaataaatgcctctctcacatgagctattagagtggtgcaaaagtagttgtggtttttgccattgacagtaattacttctgtaccacacgaatactttaaaatcctcactaatgtgtaatagtcttaagactcagaagtgtgactcagtgtggtttgaattttagatcttagaggaaacatagtatatctgcccatatcatattataaagtgtgatgatactgaaattaaatgaagtaaattcttgaaaaactttctaaatacagaagacttgcattatgtatgctgcctgtactgtgtttatatttgtattatacttatagtggttttgtatttcatattattttatatactgtatgtgactctcatgtgagacattattaatcaaatgttgactgatgaaaaaaccaaggcctagagatattaacttcttcataaaggtcataacaagttagagtcagaggtaggatgaattatttatgtattcactcactcacattaatgccaggtactaaggttgtaatagggaactggccagatactgtccctcttctcttggtgctcacagcttcatgggggcacatgtagatgctggagcaagtcgtgtggacagggctgtgtattcatccagttgcattctcaggtttacatttttttggcccccctctagtctgagaaccttaaaaggacaagaacaattacttttatattttattattcataattggatagaattccataatatttattctacaacataggtattattttacaccccaattttacaagtgaagaaactgagggaaagaaggattaagtaacccaaggtcacacagcttgagtcggaggctttggtactaacccaagcattccggctgtgttgaagaatgtggtcttaaaaacaagtgttttaacttgtcttagtttctgaatttgtaaaatggtgttaattacattttccagtattttaaagagaattagaactatatataaaatataacatgtcattagcaattggtaaagagaagttataattgttatctcctgtacaacacagagttcattgtaaaaactgaataggttaatcttactccaacagtatcttatggcatgattttaactaaaaattataaaccacagaagttatttcagaaaaaattaaatcacaccatggaaggaactttacatatattacatctttgaacctttacatatattacatttttacatatattacatctttgatgtaacatattaataattaacatacaaagcacttctgtgaccaagaggtaacattgcatgtaatgggatatcataacttttagaaccagaatagacatgtcctctgagaatccttttgctccccacgtgtgacacaggtatgccccgtatgcttactgattacctttatattacatcgctgctttttgtttgtgtcatcttgaataggactgtttgtttgttcatcggtttgccctgctgaaccataatgatcattaaggacacaactatatttgtttttttcattactgcatctcttggacctatcacagagtgggaatggaataaaaagtgttagagtgaaagaatgaagtcagatgattcctgggaataaaaacaagaagatagcaaaggggaactgatggaggataggattagggtaggaataaggcaatagagaagagagaaaaatggaaaagatacagccaggggaagagaaactaagaccccttccatgcgcctaaacgaaagctgcatcagtccacagggaagtggtgcagctaatggcaggtctcaaactgtgggccttgactctttccaaaatgtacagaactccatatgaggttacactggacaaaaccggaaaaagggcagtgtagggagaggaggaagaattcacatcaatttctaataccacctgcaaaatgacactgaattctgtattttgtttgtttgaattatcaagaacgccatgtgactataggccctgaagaaagattgtggtaaatggcaccatagtgtattattacaatagaagccccaaatataaagaaagtgaaatatttttaaagtgcctacatccatggtaatagattgattcttcaatggttttctatctttatgtaatattttaaagaatatatctccaatactacccatagcatttttttttctgctgtagctttcttggcatttcataagcaactatgttccttgttgctttcatctccaaatagtttaagatatgaagcatattgggactgcaatgctggtcaaggaggggaaataaactgagaaagttaatatggggttcaaagatgcacatgattattctaactttatagctagaaaaactgagacctagatgggttaagaaactctagtcagtaatcagaggaactaattcaaatgtagatctgtctggccccaaatcctctgcttttaatttctatacattctgcttgttgctcatattttattttcccttgccagaactctaaaagaaagaccccagaacacctgtattagtctgctagggctgccatgtcaaaataacaaaactgggtgactttaatagaaaagtatttctcacagtctggaggctgaaagtccgagaccaagatgttggcaagcttgatttgtcctgagtctctttccgtggcttgcagatagtggcctcctcactgtaggtgcacatggactttctttcaggtgacttcatccttggtattttttcctcttcctctgaggatgccagtcctattggatgaggttcccactcttacgaccacagattttatatcagtgatatggactaagttcaggtcatttatatttttaaagtttagctatctacagagactctcagagaagactaaataggaaagggactctgtctgtctgaagtcagcaagggagaaggctgtggagaaactgatctagccattgggatgggctttagcttctatgggcagtttaagtctacaccataacatgtatctatctacaatgctattggtacttactgcttgtctttgtgtcagggtatttgtgacatagtatcttttccacactgagtggcttgtgggtagaacttctattcatgatgtctggtgatttcaataatagtgtcagtttaggtctactaaagtggatctgtatagagctgaaatatctcttcatagagaaaccgagaagtggaatacagagtttactagatagggaaaataattgataatatctttaattataaaagtgataaattcttacagaagataatttaaaacatgcagacaagtaatacctgagaatcctgtcatattgaaactcataatatttgatggaattccttctactactttattcatgttaacaaaattgagctataacctatgtatgatattgaatacatattcccttattatattatgactatatcctatcattaaacatttttgtaaaaatattttgaaatgttttgaataacattatattccatctcatatagcatataatggatatttattaatgcatttaaccatttgagcaatagtatctaatctatctctattttaaatatcttgacatagatattcttatacataaatctttatttgctaggttcctagaagaatagctaaatcaaaggtaatgaacatttgcagaatgtttggtatagtttgtcacattattccaggaaagttgtcagcagtgaattttatattcttaaatatttgattattttacaaaaaaaaaagttattttattttaatttgcattttaaagtactagttatagtgaatacttttctgaataattattaaccttttatattttcctttcattcatctaatcacattcttgatgagcaaaaatttaattggggtaaggaataattttgagacttctccacgagctatcctgttttttctggttacaatcacccacactgtttaaaatgttttaccctctacaatatcagaaacttccctactaacttggtttaatgtcccctcctaaatattcaaagtgtcaacaatttttttctcactcctacttcatttacttgtagtttccctttaggtttccatatagaatcgacattcttcccgtagggtttgccagtggatcttgctgccatggggggcacaagcaaagtaaatgcatttcaattcagaagccacttagcatccaggtggcttggatttttttttcttctttttcttaaatatgaagcattaaaagtcaaaggcattgctgcaccttgagttagtacaaaatttattttaaaatgcatacagttcaaattttttaccttgcataggccataagctagtagtatggtgggtcagttctgacactgaaaaatgaatccagttagagaacctcccgaaggctgttgatgtttgctataataaatagcacacactttaagtcaaactttttcattctgtattcaaaggtaatggatttttcgtaaccatagtaaccttggtgtattctggataaatacgtgaggtatatacattctagttttatttttgaatataaactaccacattatgtattactaataatatgaaaaataggatgtaggttagtataatgacagcttaaactagtatgcattttccttctgcaaaaaataaatatttatcaaaagtataggttcaattaatttttctcccagttttgtggtattctggtggtgccatttatctttttttccaagatctccattaatctcttatttctgtcccataacagatttttaagaattttgaggtaaaaacaattgtactttaaagcttatgattaaaaacataatcgaaagattgaaggacctatattgatatcactagcagagctattgtgggccacttaagatgtgtgtatacagtacattcccaaacaagtagacaaaagaaatccttcatgagactgttcaacataccaggattgtttcaaagttcaggctggacagcacctgatcgatgatgactatccagactgtagccacagattattcttattttaaacgagcaccctaccagaaactggccgtttttaagaagtttataagatgtttccaaaaagcctacaaactttttagaaacaaaaatagcaagatggtgctaatcaggacaagtctccaccaaacccggcaaggaggtttatgcgagttgtgcttcctagttagaaaatactacctgaattgcttttggttaagccaacctaagccattgctgtggataatgactagaactccaaaagaggaaaggttaatagggacattatagaaaaataacaactatctcacaccaagccataacacgtgtgttttcaaatgtatcatctgataaatctacatagtcatcttatagttaaataagagtgactgatatctagaaccatagatagtgtcttcccactgctgttccatcaggacctggatttctatcactaagactgaggcagtaagatatagataatagcaatgtaatgagtgtgtgcatgcgtgtgtgtgtgtgtgtgtgtgtgtgtgtgtgtgtgtaattgagagacagaaaaataaagagagggtagaaaggcagatgtgggcagggggaaagagggaggaaaagtggatgaattctggtaaaatcatataggcaataattatttatgtctaaccaactaaaagtgctaaaactttttttttggtcttatttgccaaggtcaaagagaactatgtgtaaatagcaaaatagaaatgctcatcttaaactttccaaacacttaagtcttacgatgggaaatttattgacgaagaagctgtattgcttatggcacaataaaaacacatttaaaggttaggcacttctatccgagcgttataaggaaccttatcagcactctacaaatttgagctaaattatactcattcacaccaatggcttacagaagctcttttcttagcaaaatagaattttactttaacctagatattttctttattttgcatatttaaatatcacattgcagtacattgaaataactcctcttacataaaaatactattacctaaaggaatgctgttaacacgcctgtgttctgttacaagctctaatattaataaagcagagcatgtgaggatttccaggtaagatgacggtctcatccatgagtcaccatgccactctattacaaacgaggtcataccatgtttccctttgatgtctcagtcatatagtattaaattgtacaaagtctgagaaactttaaggacacgaaggaacaaaagtcaagctatgcaataagtagagccttcaaagccaaattactaagctactaactctgtgaccagagactccagaatagttgttcaaggttgttctatataccagatctttgggttaatgaacagtggatgctatactctcaagagtcttattcatcgagcaacaaagggtcaaatgaaatgaaataacttgtacagaatgtttgaatatcagttgtggttagctgtaaacaatacaacctaagtgtcgttcttccattaaggtgcttctataatgcacccgtatgtgaagaaataaaatatgtttaaatttacattttaagacccgtacccaaatattatatgatctgttaacctaattaaggaatattatgttcgtaaatgatagggaaagattctatgcttaaagggattttagaagaatcatgggaataatattcagttagaaaagcaatggagttaaatgctggaaagataacggaatatgtccttcagttgaaagtgttacaaatagaggtgtcctgttattttcagcattttgagagttgctatgattttttatgtacgttttaaagtgcttaaattgagttataaattaatacagaaaagtggacacatcttaagggtacagcttgatggatatttacaaaggaaacacatctatggaatctgtacccaaaacaagaaacagaacattgtcagcaccctgtaaagctcctcattttgtggcctcaaatcttgactcaggtgattgctttcctgagtgttgacaccataaactgattttgctaattttgtactcaatataaatagaataagaaagtggagggggggtcttcaaaaagcttatggaaaatgcatattatgaaaaatgtgaggatttcaattttttccaccaaaataaactcatactaacttgttataacattcctgaaccagatctagtttgaggtggtaagaaagttaagacatcagtctgaaacaagcccctaccagggcaacatgaattcagtaaaattgaagcaaggacaaatatcaaatttctggtgaagcttgcatagaagaatagtgaaatcattgatgttttacaaaaagtttttgaggacaatgccccaaagagatcggcagtttacaagtggataactcattttccttaaaggacaaggaacaagacagtattaaagatgaagcctgcagtggcagaccatccacatcaatttagaagggaaaatattcattttgtctgtttcctaattgaggaagacaaacaattaacaaccaacatcatacacatctcaattggttcactttgtacaattctgactgaaaaattaaagttgaggacattaaacttagcaagctaacataggaacggaaaaccaaataccacatgttctcacttataagtgagagctaaatgatgagactcatggacacatagaggggaactacacatactggggcttttcagaggtggagggtagcaggagggagaggattaggaaaaaaaaaaaactaatgggtactagacttaatacctgggtgatgaaataatctgtacaccaaacccccatgacacaaggttacctatgtaacaagcctgcccttgtacccctaaacttaaaataaaagttaaaaaaaagttgagtgaactttctacttagtgggtgccaaaactgttgcacccagatcagctacagacaagagcagagctttcaatggaaattttaaacaggtggaatcaatatcctgaaacattttatcaaataattgtaataggagttgaaatatggctttaccagtacaatcctgaaaacaaagaacaatcaaagcaatggctactaagaggtggaagtggttcactcaaagcaaaagtggaccagtcaagagcaaaggtcatggcaaaagttttttggggatgcttgaggcattttgcttgttggttttctggaggaccaaaaaacaataacatctgctaatgatgacagtgttttgagaatgttagccaaagctttagcattaaaatgcccaggacagcttcactagagtccttcttcaccatgatgatgcccctgctcattcctctcattgaacatgagaaattgtatgacagttttcacggaaaatcattaggatcttacagttctgatttggttccttctgacttcttttcgtttcctaatcttaaaaaaatctttaaggagcacccatttttcttcagttaataatgtaaaaaagactgcattgacatggttaaattcccagaacagtcagttattcagagatggactaagtggctggtatcatcacttacaaaaatgtcttgaccttgattgagcttatgttgagaaacaaaggttatatttttattttttaattccattttccatgaaatttttgtagttcccttatatgttctcttttgtcactgtctttttcttagagatataggagggagagtaaatcagtacaacaattttttgtgttcctgtacctacattcagaaccctctgatctacaggcaattgctaagatgttgttagttgttaaattcctgtcttccagaaagccattggaaaatttgcaaactgaaacatctacctctttctccaagttcagatctagaaaataattatagaaatgcttcatctgtgcaattagaatttagcacatgaagtcactgacccgtgtacactagcaacaaacaaaccatataaaccattctgagtttccaacaatgtaatgttgtgtgaccataaagtttatgatgctgtagaaaaatatttaatttggaaagataataacaacaaatattttacacatatttgagtctaattcgttaaaatatatgtgtatatacatagatacatatacatggatgtgtacatatacatatataggtatgtccccatatggacatataccaaaatactaatagtgattatctcttaataatgggagtctggtattgcttttttttcttttccttgagagtcgttcaatcttttaaattctctacagtttggatattagaagtcagattctttttgtaatgttattcccaattttaatatatgtgataaaattgatagaaaggaaagaaatttcgggaacctgactacacttaaccattaatacttatctctagttttccctagtcttcaccttatatttaatcaggttgatcgtcttactaatttccttctagccaataccatagatgacctctagcactatctaccaccatcaaaacgttatgtatatttgatgatctacctcaattcccacatcttcatttgactcatagactcttccatatcaaattcctacacatttgtcatttggacacattctatcttgcaatattgacttattttcaaaggagtaaatcttgattaaaaataagaatgtaagtgcattggttacagttattatgccattatttattttcaaaatttctgtaatatctcacataggaataaggacccaactggcatccaacaaactcactgaattgagtttaaatgaattaagttgaaaaaacactgagactcagtaaattaatattttagagaaaataacaataaataccaatgcataatttggatataattaacatgctaaacttggtaaacaattttattgaggtaggctttcctgtagcttaggatttttcatttaatcatccaatatatagcaaatatatacaaatatttgttgctcaattatgtgttttagcttgctaagactattgtaacaaagtaacacaaactagatggcttaaacaacagaaattgactgtctcacacttctagagacagggagtcccagatcaagatattggcaagactggtttcttctgaaggctatgaggaggaatctgtttcatccctctctccttgttttggttgtttgctggcgatatttggcatttcttgattgtatatgaatcatcccaatctctgccatcatcttcacataatgttttccctgtgtgcttatctgtgtacaaatttctcctttttataaggacactagtcatattggatttgggcccaccttgttgagctcatctgagctaattacaactgcagttctagaggctaggacttcaacatatgaattttggggagaacacaattcaacgtgtaactctagtgctgtgcatttgatgctgtgattaataacattctaaaactttcctgaaatacctaaaacatattagagaatttaaggtgtgtgttcacaatcagttttaagatggatatggcccatgacagtaatgaaaatatttagaaaaggtgataatcaattccatctggaatgctcccagccttactttttgcatcttcacaatcacatctcttacttccctggcttgctttctttgattctttataggagtgattagtttcctagtgctgcttaatacaatacccaaaatgggatgccttaacacaatagaaatgtattctcttgaagtttgagaggctagaagtttgaaatgaaggtatcagtaggcccattgtctctctgaaaactgtaggggagaatccttccttgcctatcccgccctccagtggtttctggcagtcagtggtattctgacagtcagtggtttctggcaggtgtctgtcagtcagtggtatcctggcagtcagtggcttgcagttgcgtcaccccaatctctgcttgtatcattacatagtgttttcccttcttctaaagttctctcctcctctaaggataacagtcatattcaatttagggctccccgtctttcagtatgacctcaacttaacttcatgacatctgcaaataccttattttcaaatgaggtgacattcacatgtacagggagttaaaacatggagataccttttgggaggacaaaattcaatccactacacctccattgactccacaactactttgccactcagttgaaactgttctcacctagattgtcaatgttctggtagtctccaattcagggacagagtggaggttgtataattcatgatgttttattgatgattcctccatctcagaacattcttctcttggtgtctgtgatacctcaccttctcaattttccctattactgttcaagctctggtgtgatctcttcctcattttcttccacgcacaaatgttggtttcccccaggattcctcttgaaacattccacacaatctccctttgaaaactcagtagtccttgtcttcagatatttttcctaagccatgaacatttttctcactgcatattgggcactcctgctacaagtgtttttactccaactccttaaaactgaatttattttatctgccacatcctaccaatgtgctcttttttctgagttttttatctttgggaaaagtaacactattcattctttttcccaaacaaaaacccagcattaatctttgattactcctccttcatccttcacatccaaacttttttgctgttcttgttttaagacagggtcttcctgtgtcacccaggctggatggagtgcagtggcgcattcacagctcactgcagcctcgacctcttgggctcaaatgatcctcttgcctcccgagtagctggggccacaggtgcatgccactacacctggctaatttttgtagagatgaggtttcaccatgttgcccaggctggtcttgaactcctgagctcaagagatctgcacatccagtcttaaaatccaaactgctgttgccctattacacttatcacctggctcctatctactttcttagccttatatcattcttttattctcatttatttctacaacactacattggttttctatttctgttggtttgttttgtgaaataccacatgccttttcctacatgcagacttttgaactttctgttcactctgactggaatttactttccccagttctttacatggctgaatcattgtcttccttgagttctcagatcttataaaaccttctctatatttgttagaataacctagatgttataagcatacacacatatacatacagagagatgatagtttttaatagtgaaaacacaataaaagtttatttcttgttcacttagcattgagtgcatacaaagtttggtccacagagtttcctttttctgcacagtcattcaggaatgcaggcagatgcagattcagattctgtcttatttaacacatgacttccaagggagctctggagttatttccattgctacagcagatgaggaagaagattgagagatcatcatggcagattgttatgggccaggcctgggagtgaaggtattaaagcaataccttgtactaactcaaagttctgtaaatcagaaatttgggtggatttaattgggttcgtaattagggctttacaaggccaaaatcaagagttggggcagtttgggctctcatctgaaggctctgggaaataattcacttctagactcattcaggttgctggctgaattcagtttcttgcagtggtaaggccaaggtccctgtttccatgttgcctgtcagtcatgagctgctatcagcttctaggggccacctcaggtcctttcacatggctccctccatctcaatgatggaggatatccagtccccctcatgcttcaaatctctctgacttttgcctccagctggagaaaacactctgctttaaattgctcgtagttagtttgcacccaccaggattcatttccttttctccatataaggtaagataatcataagtgtgatatctcatgaaattcacagattccacccacactcaaagggggaaaattgtatataggtgtgtgtcactgggagtcattcttagaattcttcctaccacaggttcagaagcagaatcactcaagcatggttcttaccctgtgaccttactaagccttggtttcctggtagaatggtaacaacagtacctactttagggatttagtataaaaattaaatgtgatagtgcatataaaaagattagcataggtcccataactcttctaaaaatggtaaataatcaacaacccatgctattagtcgcagaaataaggaaattattgttatatcatcataaatattcttaatgcaaaacatcctctgcatgcaaaaaaaaagcatgtctctaaacttcatgttcaatttaactcagaaaatatttgttgagcaggtactatgtacctcagaggttagaagttatttataaaactaagatactgtcattcttcctcaaatcattcccagttcaattgcttagacagaaatacataaaactaaatagaatgctgtccaacctgtggtaaattctgtaacatgtgtgacaacaaaagagaagggttcaacccagtgtggaagataaagtgtcacagaagaatgttcacaggctttagagtcgagtttaagaactgaggaacaggcaaacataaggaccatggttgcgtagtcactagacacagaactattaatgcgcatttcacaaaaattaaagagggaagagtttaatatgagtgtgcaccctgggtaagtaatcaatagtgagaagcaaggtgggattgagattatcaaaggtgctaagttatgttgagatatttgaactttgttctgaagcaagagagaaccattgaaggattttcagaaataccacaagacaatcagtgctttagaaaacacatagttggaacatatcattgcttcaacatagcgaagactgagtctgtgtagctgttttctccatttagcaggcataaggacaagtgggttagaacactaaatgcaagaagctaattggacttaacaatacagatggcaaaaggatgaggagaggagagaaacgcattatgtttatttgttaacagctctattgtattgtatttatatgcattagtcagtgtaaaataaaatctgcttattttaaatccttttaaatagtgtttaaatatttcctgatgacacaatctgctaaagtatttacccttggtgcagatttccattaaccttgctgtagatactaagcctacaaccatatatttatagggggctcaattatggggtaaagcctagtgacatcattataaaagcacatctggataagctttagggtctttgtctttctatctgatttaggaaatttagtaaactgtaggagaataccattattaacagcccctgaattctcagattatgaggatgtcctttctctcaaaataaaggaagagagggattaaaatctctaaagctgtaaatgatatagagaaatgcccagtacacagatatcagggatattaggggaatccagttgtgttggatatacaagaagaaaaaaaaggcagaaattaaattcaaagtattctttcctcatgtcttttgtcagtttttttttattgttttttagagagtctatataaatcctttggttccctaaaggacaaaattcctttgataattttacaaattcttttctaaatagtatctctgtattgtagattaaaaaaattaatacctaggaaaggtcaggtcacttctttcagtcaaggaatgactcattcatgaaactggaaagaaaacttctttttcactcaccccaatacttgatagctatcttaaattgaatatgtctttaacagtatatttgatattatcagtgtattttgatttatatatatatatcgtatatattatatatctgtgatatatatctatatatcatttatatatctgtgatatatatctatatatcatttatatatctgtgatatatatctatatatcatttatatatctgtgatatatatctatatatcatttatatatctgtgatatatatctatatatcatatatattatatgtctgtgatatatatctatatatcatatatattatatgtctgtgatatatatctatatatcatatatatatctgtgatgtatatctatatatcatatatattatatatctgtgatgtatatctatatatcatatatattatatatctgtgatatatatctatatatcttatatattatatatctgtgatacatatctatatatcatatatattatatatctgtgatgtatatctatatatcatatataatatatgtgtgatgtagatctatatatcatatatattatatatctgttatgtatatctatatatcatatatattatatatctgttatgtatatcatatataccatatattatatatctgtgatgtatatcatatatatcatatattatatatctgtgatatatcatatataccatatattatatatctgtgatatatatcatatatatcatatattatatatctatgatatatctatatctctctctatctatctatcacattttctttaaccattctatcagtgatgggcatttaggttgattccatgtctttgctatcatgaatagtgctgtgatgaacatttcttttgatttttattgtctgtgttaggacatcataacagggccctcctaataccattaacaacgcatcatgaccctggtaatggttttgtagctgaagtctagatagtttaagtgccctatcttattcatttgtacatattcaatatatataataactactattttctggacgttaagagaattgctgaaaatacagtggtaaactgcaatgaccctatatatcctggtttgtacactgttttatcttctgtttcagttaccttgcttaaatcttgtggctatatgacactaataaaagttaccaaatttgtaataaatagcatcacaaatatttcattgtgcttgagattgtttcaaaggttttgatttttctggctatacacacacatatgtaacataacataattaaaaatgtaatgaacatcactagactactagttaaacaagttatggctaataactaatatgtacacaaaatatgtggacacaatagaacaagcaaatctttatcaataggagaatatcttcaaagtgtatattgtaaagcacttgtgcagaaaagtatattctatattctgctaatgtttatttgtttggttatatgtatgtagactacatctggaggcatacatataaattcaataattgctaaattcctaggagaaaactgggtaatagtgacacaaaggtggagagagtcttaatttttatgtaaggtcttctgtacattttggctatcgtaccatgaatatatattaatgcattattcattcaaaattaagtacaatttaaaaataaaattactacaaaatggtaaattttaaatgttaaagaaaacttggaaaaatataaagaaaaattcaaattgtccacaattttatctaccagacacaatcactaattatattttggcttatgcatttaaagtctgtttttttattattaaagcacagatacaaacatataattgggaccagactgttttacaactttttaccactttataatatactaagcttattaccaaattgcttgctcagcattcttttatgtaacattttgtgtatgtgcattttaagttttttaaaattaataccacaaatgtgtttatgcattatttaaaatgatatattcttcttcctattttgtaaatgttttaatatatatgaaggatgctaaccatttgcatgcactctatatgacagttatttttttccgctttgtcttttgtatttttttactttgtttatggtggtttttaaattaagacatttttaaaacttgtagtcaattcaaatttagatatattttccagcatagtgtcttccttaaatagaaacacttagattttcttcacttcaagaatagataaatatttcctgagattttctttgataatttatactttcaaaaatattttcacatattccagcttctgtgaatatttttatttatttatttatttatttattcatttatttattgagacagggtctcactctgtcgcccaggctggtgtgtagtagaatgattttggctcactgcaaccccgcctcctgggttcaagccattctcctgccttagtctcctgagtagctgcgattacaggcatgcaccaccacacccagctaatttttgtacttttagtagagacagggtttcaccgtgttagcccggctggtctcgaactcctgacctcaagtattccgcccaccttggcttcccaaagtgctgagattacaggcatgagccactgcacccggccacttctgtgaatctttaaattacccaatgatgtgtataagggttcaaattttattcccattttctcagtgaagaaatagagattctgaaaactgatttgatatgcctgaaatcataaagttagttaatgtcatcgctaggactagaattttggtgcttacacaatgtgctgactcccaaatcgtaaatttctaccagatgtttaaagtaaaagaatgatgggaaatttcattaaactattaactatattcagtggtttcaaaatattaatacaacattgatatctttagtgcattatcaatgtattcttggagacaacatgtcaattaaattgtctcttattcaaatgttaacttcagtttttaaaatttaaagctagtctgctgattttcaataagagctgtctaatattgtgaactagtgaatttgaggagataaaagtggaaattataggtctgcagagtgtagcattgataaagagggggccatttcttccaagtcagtaaagaaaagtgatgaaacataaactggaatttttgtgattctactgttgcatgaccttataacacccctgttttaattaactacggacctgaaataataacgtatatttctaatccactcacaggaatggtaggtatattagttagctagggctgccatgacaaaatacaggctgagtggcttaaacaacaggaatgtattgtcttacagttctgggtgctagaagtccaaggcaaaggtttccataggttaggtttcctctgaggcctctctccttggcttacaaattgccgccttcttgcaatgttcttacgtggtcttttctttgtacacgcacaccctggtgtctttattcccatccaaattttctcttcttataagggcatctgtccgattgaattaaggctcatcataatggccttattttgacttaattacctctttaaagaccacatccccaaatatggttacattctgaagattagaatgtcaatttatgaattttggacggacaaaattcagcctatagcagagggtctgctttgcaatgattatgcactattactcaccaaggtagtaaaaattaagcaaacatttatatacacaagtttttgaggggataaagcctacagaatataagaacaaaatattttcaagaatgcctgtctgtggttctttcattaattcacttcttcattcatctttattgagtacgataatgaggcagggaaaatataaccatctgactatgaattgacctggtgcttgtagacatatgtggtttaacagttttccactttgtgtacccctctctcataacatgtagcatactctgctagaattattgattgattaacctcattgtctttctcactagatcatgagtactttgagggcaggaactttatctttcatctttcatcctgaagacatggatcagcatatgtgtatagtaggagaacaataaatagttttcagaatgaaggggagaattaattttttcatgaaaactagatgtcattatgtggagaatttatcagaatgccagactggtaaggatgttcagagacacagtagttgacctaagactaacctaaatctgtttgtatcacagaagtgtaccaatgcttgacatacattggataaaatgtttatttcctatttctctgtattgtttggccacatgactattgcaaagctcataagcacaaaatttgcacaaaacccctgagagatgccatccatggctacaaatacatgttttgattatattaaagtaaaaaaattgatcaattattttaaatattcaaggtagttaagtgaataaattctatgtaattacaaccacaaggttggtgcatattttagaaataaatgcttgttttactatgagaggaaaactgcgaatggcacacgacctaaacaagggcatcctgtttgcttggatgaaaattccatccccatgtttactataccttccactctcattcaaacctagaacaggagaaaaatagttcgagtttaaaaacaaatccagtagagtttaggaaagtttgtctcgtataccacacctttaaaaggctattttgcaatgacaatattcttgtattgccctctctatttttccctccctattgtatacatgagcccagcaacttctagaatatactagcacatatgaaatttttgaatatctatttcatgtagggagattagaaagtcactttctgccacttgtgtagctctattatgcaaaaatcaagaggatgcagatcataaatcccattagggtggaactctggatgtggaaaagactatatagataattttaagagatttcccctcagctgaatcattgctataaagttaagcatggtttttaaaatataaatcaaataaatggtttctataaaggcacatacctttactgtaaactgaactccaacaaacttttgagtggacatttctcaaatacagcatctattgaaaacttcctctgaaaaaacatttcataaaaattgaagcttgccttacatattttcatactatgtggttttaatgaccgttgtattccactctatcaccataaataaatatgtgactttaaaagatatgttgtaaataaaattagctcgaaaatactaacactaaccaaacattaatcacagaatttaaggagactatcagagactaattcagaaaataaaaatattgtaaaattactaccatgaaagctctaagaaaagttcatgataatttcagtgatgctaaggctacagaccaaatataaacttagaaacaaaagtatttagtctaagacaaattaaatgtgtatatattaatttattttctctgtttgatgggcatagaagcccatcaatactctgaatttatattttattaatactctcacaatttactttcatatgtgacttactatgtaatataaaaaacaaaagagcttgaaaaactgagatcagagggcaacaataaaatattaatgctaatattatcttgaatttttatctatacatatttaaatgttgttatcctcactgaaatttgttactaatcagtgaaactttagtatttacctaaattagttcttcttataagtagctcaatctccataataggagatagactataatttgtactttagcataaatattcttctaaaatcattcaccgttttatattgtaattgactgaaacaatataaagtggcttaaaatcattggtatattataaaacctatgtcagataaaacatggcatctgtgaagtttgggaattataacccagaacagtgtataattcaaaacagatacctgaaattatcttgtacacatctcgctatctgctatatctcatcacataaaatgcatagtagatgcacaaagtagctgtccaacaaatacttatggaattaataaatgaaggaatgacaaaaatgcttttcctcaatgtgctaagtcaaatacatgtttccttttataaaaatttaactatatgttttagatttagttgaaaaaatctatactggaatttacataattacataatacatattttaaagtattattcccagtatttatgaacattcattaatgagaatggcttctacattaaaagatcagttagcctctgctatttttgataatgatttaaacttgttaattcttacctgtataatgcattctcctttacaaaatgctggtatggccacttgttttatgttatcctcacaacaattgtaggtatagatgtgataaataatatactcttcctattctgtttttctttttaacaaatgagaaaactgaggcctaaagctccagtgattcactcatgtttacacaaataactctaaactggcgctcagctcttgctaattctttgtctcctcttttgttttgtttttgtttcattttgtttccctaaaccataatgccatccaatattatttaaagtttgcctgcctgcttttgcaatggttcttagctttccacaatagcaagtgcatcaaagaagaaaaaggaaatgattatatggttattaatcaaactcagatatggctagtaccacctttataagtgaaacttatataacaatctcagtttatgtcagtctcttatcccagtgtttaaagttttaaggactgagctgggaatgtgaggaggcttttgcttttcattttgtactctactagttttaatttttcactatgtgcatacatctgcaccccaacctttaaagaattagtttcctgaaaaaaaaggaaaatgcaattcatcgtacaaataaaagcataatcccttttattaatttttagctaacaaacacataataccatcctattccaggtactgtttttaaatgacttgtatctaaatgtaatgttaacgcatactttcgatgtgcataaatatagccaagcagtcctaaattcagataaattatcttccatctactgtatataattatatagtatttcctaatttttataaaatatggtttgtgtgtatgtatactgttactcaaatgaggttttgttgtttttctctcctcaaggtcaaaaacaatatctcactctatcttttgtgtcttttgttttttgatttttttttttttttttttttttgtctgctttgaacagtttttaagaggaaaagaagaaaaggtgtttgggggttacataaaaaaagggagaaagagacccaaatctcctgtctcttttatcacctacaaactgtattgattttcactttcctttcctaaatccatgctttaaagacattgtccatctaagaaacatagagtcccaaagcacaagttttgatgtagtgagcacccattgattgtaccttgaagtggatgtaggtaaacagatgacagatagatcaggtagatatatagatatagatatagatagatttatcttgaattttcctagatcccattaatctgaatgtacaaataagtctcattagttctaatatttgtatttcactgcctcattgccctcacctgctgtagatgatctctgcctccagcaaactaatcctcatgcatttctggggagtccatatgggttttctcacttgcacttaggatcaagctggacaccaattggctaagtgccacggttactccactgggcatctccatgtcccttctctggataaacaccatcatctatgggcataaggagcactgctattcttccattgctgctccaccaggtacctgagctctcccactgctgtgccaggtggaatagttttccaccaggggccaccttagatattcctcgtcaggtgagtaccaggactgctttgctaggtagagctgtcccagtcgattctaatatgcccctctgctgttatatctgtatcactgttctgtattctgctagtaccaaagctgaatgagactatgttaaaagtagtggtggaaaaatgtctttcttccttgcctccctctttcttaagtgagtcctaaaagaatactgagtagattttggtatcttaaaggtttaacaaaacagatcttctttgttttactctaaatacaaatctgagtaaactagccaaggctctcagaatgatctctctcttctgagaaccagggcaccatacctggctccgatttctctcatggtgaattcttcaaaatgttttccagtgcatgggctttcgctgggttatctcccacgttgttcacaatgttcagagatatctgagttaacagcacacccagaggtgttccctctttccatgactgtcccccacaaccccacgccaagaatgccactccccagttctaatggcagtatgctgctggtagcctggccacctgtctcagtccatttagtgttcctataaaggaatcacccaagactgggtaatttataaagaaaagaggtttaattggctcacggttctggaggctgtacaggaagcatggcagcatctgattctgaggaggcctcagggagcttttactcatggtggaaggtgaaggggagcagatatatcatgatgagagaagaagcaagagagagagagagaggaggaagtgtcaggctctttttcaacagccagttcttgtgggagctaagagtgagaactcattcactcccatgagaatgatgccaagccactcatgagggatctgaccccaagatccaaacacctcctaaaaggctcagcctcaatgttggggatcaaattgcaacatgagatttggcagggccaaacaaaccctatccaaaccatagcaccacccaatttgccagatatacccaggcagatctaaatatatcttacactcacaatcaggtcctccttttatgagataccaaagatgttccattagggttctcagacaaacagaatggagaaagagagatttattgtaaggaattggctcacatgactgtgggagctgacaaatctaaaatctgaagtctgcagggcatgttagcaggctagatatccagggaagagttagtgttgtagtcttgggaccaaaatcttcagggcacgtattagtctgttctcacgctgctaatagagacatactcaagactgggtaatttataaaaaaggaggtttaattgactcactgttccacatggctgtggaggcctcataatcatggcagaagagcaagagatgtcttacatggcagcagacaatagagaatgagaaccaagcgaaaggggaaacctcttataaaatggtcagatcttatgagacttattcactaccacgagaacagtatgggggaaactgcctccatgattcaatcatctcccaccgggtccctcccacaacacgtgggaattatgggagctacaattcaagatgagatctgggcagggacacagccaaaccacatcagggcagatgagaggtttttgttcctcatgacacaaaatgtggtgtcttttccaacaccacttcttcaattctctgacactcactaggcatgctatagttcagctcagttctgacagtaactacctggagttagagtaagactccatagatttaagagcccagtcccacaagactaccttcccttcagaggccaggcacaagtattgagtccccactttagccacaattctctccagctgagctacacagtcttgggttcccacaaccccctcttcagggttgataatttgctagaatgactcacagaactcaagaaaatgctctacttactattgcagtttattttaaaggatgcatataaacagccagatgacaaacctcctcaaattctgtttaggggcttttaggaggtttcatgacataggcatgattgatcaaatcattagccattgatgattgactcaatttccagccactccccttctcccaagcggttgctgattgagtagtgaagctgaaagttccaagcttctaatcaaggtttggtctttctggggaacagcccttattttgaagtagtctaggggccgtctgacagtcacttaattagaacaaaagatgctactatcatctttatcactcagaaaattccaaggattttaagagttctgtgccagaaacctggtacaaagaccaaatatcttcttatatcactgcaggccagcagactggaaactcccatagaatttttatcatgcagtcttgaggcagaattctttcatctttgggaaatttcaatctttgctctaaaggctttcaactgatcggatgtggccaacccatactatgtagggtaatttacttaaagtcaactatctataaataaatgttaatcacatctaaataataactttatagcaacatttagattggtgtttgatcaaacaagtggataccatagcctggccaagttgtcacacaaaagtaaccatcacagatgtattattttatttaaaatcatcagtattatatgaattaattcagaaataaaaaaggtgttgtcatagtgtgaacacttataagtgtctttcccacagaaatgtcaacagactgtgatttgaaaattgctgttttaaaagagaaaagctcatcattctacagaaatgattcaaagatagacaatccattaaatatcttataatgggccaaatactactagttgttaatttacacttgcaacatcaaacactttaccagctttttaacatgcaactgttgcatatgatgcattgtgttttttgcaagtaggtatacagcataattctaataggatatttatttacaacctaaccttacaatttaaagtctgctactccattgtgctcatcctacccgctgtcttcttatattcaaagctattaaggagtacttgctcagcatatcactccaaattaaactgcaagacattttatgatgaattaaatgggtgacgctctcccagcctttgtaactactagagcaagtatccaagaagcagacaattttatcacaaaattctgattgccaagttgtttttattaaatagacatacagtagagaatttaatcttagaaagcatctaacataaacacagatttctcgttttatagatgaataaactaagatccaatgagggcaactatttttttccaagttcatgcaggcagctaacaccagaacaaagactaaacaaagctcttctaacttctccccccatttttatcatccattgcattcattactacaaaattactacaaaattattagcctggtctttaatggtggccccaaagaatggtttttagtattacttccttcacttctttcgtatgtcctgtgctccagctaaactgaactatgttgaactaagctaaacatttctccttaagcttgtactgcattttgctacagtctttttgccaactcttcccatccagaatgtcttcactctctatctccactgctttaaaacctaagcaattttcaatttaagttctatctcctttttgaagtattgtatattcttctagccagataaaattctaggaaaatattgtcatacttgactgcataaagatttaaattgtctatatagcaaaataaaaccattattgaaatgataaaacaagtgacaaactagaacaaaatactttatagcatacttatttaataaatatctattgatagcttgctaagtaataggcactatactaggtgctatatccaagtaatgttgacttattagctttcaattagaaaaagagaaacactattagatatgggtcaattagataaacaggcacatccaaaaagaaaaaaatatgtaaatatagtcacagagataataataataataataaatgagatgctacttaacatttttcaaatgtgtaaatattttttaaaattagatttttccatattgattagaagatggagaaaagagctctttcacataatgctgctgtgaatgaaaattggcaatttatatcataatgtgccacagttttgttctgtatggtctcaatcccccctgtaaatgtgtgctctacttttctctaccttgtcctgagctttagcctctggattctctttgggttctgccaacgtaagacacaataaagagaacaacagacaggagggaatgaggccgaagtgtttattcctcaggctctgtgcttgcaagggtccccaggctctgtgcttgcaagggttcagatgggcagtagctgttcctccattgaggggaggcccttcctacagtacagctgtctttccagctggatgtggtcctcagcctaaggcagcaatggcttggtctgtgtttagccactagctgcgttcttattcttgaatgtgccccttaagcctggcccaaatcctgtaaatagtccctgacatatttctcttcaataattccatttcagtgtgccatcttctcccttgtcaggaggaccccaaatgatccctctttgactgggaaattctacttctaagagtttatgcttaaggtgtaattaagaatgtacccaataatacagtaatccatattaaatgttataatagtagtaaaaatgacactagtgaagcacaaaagagaaattaatccaaactgaaagagtttgagaaggtttcttatagggtgtggcatttgatttgtgtcttaagggtagcatgagactatgccaaaaaagaaatgtgtatgtcttgccacccaaaagagatatcttggccattgaggatagagattcattactttcttatgctatataaggcgtagtatagggctaggttgaaatagtattaaaataatatttaaggattgattataggttttcattgagaaccattctcaggtgatactttactaagctgacaatagacttagcactgcctggcaaacagcaagtagcagtcagtgatatagccatgattattactgaattaacagcatcttaatcttcactacgatatttgaaagggaacactgattcataaacctactcttttcctgccacaggtagtcaggaacttattattcttattatgtctcattattaacttctgttgcctaacaagatattatatattgtatgtcacatgaatattttcttacaaagtattaattgattcctaatcttgttaaagaatatgatagtagcaaatatccaactaattctgagagaaaaacctccagttttgcaagaaagatttagccaagttatgcaactaagtttgttcaaataataactctataaagttatctcgattatctcctctttagtttatgaatcgaaagcattgatgaagatcaaaagctaactgatgcctccctaattctatatctatccttgtgcagaggcaaagtaggggagtcagtaggatgtttgtgtgtgtgcgtgtgtgtttttgtatgtgtgtgtagatggagacagagaaccatagcaagatagagagagaacacgagaggagactgagagagaaggaaagagggaggaagggatggatggatgaaacgaggggctttctctcattttatatcataaaagtaaccaagaaaaaaatcctgggttcaatattttataattattacaaatggggtattagagatgttcaggaagccagagtagaaggcagctagctaagaatgctgtcagcctaaggagtttttcatggacgcctttttattctaaccagccacagaagaaaagagggaaatgaagaagcatcatccttcactatcacaactgacaataagggttctcccttacctcccacccccgcccccactacacacacacacacacacaaagtagtgactgaaaaccctcagcaggctgggctcccctaccacatgccacctgctgcaaatgtgttggaggcaccaggtcctcctttcttttttgccagttttcttattgcagaaaggttttactattcaacaattaggagtgtccaaggtgttaggggtcataagatacatccttgttctcaaagcgcttataacactgtaactactgatgactggtataaggatgcttacaagagaaatttattaaaagggcaactcagtagagtacaaactacgcatatgttgaagagagtcaggagatgtttcatggataatgcaaacattgaacagggttttcatgaaagggagggatgtggatttctctgataaggtggaaaacataagcacaaatggaagaatttgttgagtttagtatgtggtttgtgttcagttttaaatataagtccttatcatagcaaagcgatttcttttctttttgtttttgttttttccttttttaaattattttactttaagttctagggtacatgtgcaaaacgtgcaggtttgttacatatgtatacatgtgccatgttggtgtgatgcacttgttaactcgtcatttacattaggtatatctcctaatgctatccctcccctccccgcccaccccccagcaggccctggtgtgtgatgttccccaccctgtgtccatgtgctctcattgttcagttcccacctatgagtgagaacatgcggtgtttggttttctgtccttgcaatagtttgcccagaatgatggtttccagcttcatccatgtccctgcaaaggacatgaactcatccttttttatggctacatagtattccatggtgtatatgtaccaaattttcttaatccagtctttcattgatggacgtttgggttggttccaagtctttgctattgtgaatagtgcggcaataaacatacgtatgcatgtgtctttatagcagcatgatttataatcctttgggtatatgcccagtaatgggatagctaggtcaagtggtatttctagttctagatccagacacatgaaaaaatgctcatcatcactggccatcagagaaatgcaaatcaaaaccacaatgagataccatctcacaccagttagcatggcgatcattaaaaagtcagaaaacagaaggtgctggagaggatgtggagaaataggaatgcttttacactgttggtgggactgtaaactagttcaaccattgtggaagacagtgtggcgattcctcaaagtgatttcaactctacagatcagtttgaaagcacaggactggatctcagtgatggttaattgctcatctggccaaagaaaagcatgttgcaaggttaaggctcctatgaggaaaaggagagcaaggatgttcaggctgaataaagcccctgtttttattaattataaggtcagaatctggttctcctggaatcaaaatgctgagcaagcaattgtggagcaagggctacacaatggcagagatgaatgcaacctgatattccacatgcattctggcgcagctcattgcttttcaggcatctacgagaaacatatcaccccttaggtttgctgccgaagatgtgttctcactgaaccataacctagcagaggttctcaggttggaataccaaatagcaagatgatgtggtcagtgctacctatattgctctaaaatttttaaacatctaattgatgatttgtgggaaggttgcacagagagaagaaaggaaaaccaggaaaaagctgtgtttttaatttatgaaatattaagaagttttcggaagaagacccagacaatatgtattagatcataaagaagcaaaaaagtgctatgtaattttctgatggtagaaacaaataagaagatataaattcctcagtttacaccatgagtttaaagaaaatcatcacctacttactggttcattttgtaaattgagatcaatgaaattctctgaacaacagcatgaaatcaatcgtaaaatagcacataattcatggccagtattgtaaattatagtttgcttgacagtaatcggtaaggtttccatgcactgggatgcatttccttgtaacacgtctaaggataatgcctgtggatccatttctaatgcatattagagtgatctgtttttccctgtccacaactccctgtgtttgatcttatgcaaatgatgcaatcaagcaaatggaaaacaagatgttgttgctcaggggctcttacaaacagtggccttatgttttcagggtttccccaccctccatttacccaactcagatttgtgtacatacctgcaattgtttgaatccgttgatccatttgtgttgcccttgaagtgcctaatcacatctatagagacatattaccaaatcagttgcagttaagctaggaggagagttgtcattactttcctctttgctttaaatttcaaattggtggctttgtttatggcttcactctcaaagaatttatcagcctcacttccctgtaaccaatctttttttcatttctttttgttaactgtttttaaaaactctctcattccattcatacattttacacatgactactccttccccccacgcccaacctgatgcctcctcctcttctccatttttttccctttccctcatcatttcctcctgttttaccaagaatttcccaatcagatcaccgtgcaactttctctgccacatgtcaaattaggttctcttctctctctctctctcttttttcatgctttattattcaaagaacactagtaacatttcatcttcttatggaaatacattgagaataatccactttgggatggacagtacaggcataaaaacaacttggaactcaaaaaagctatttaatcacaatggttttctttgtattatgtttacagttttcagatttttaaaaccaaaagaaaatacccaatttctattgtagtgactttcatgtgagtccgtgtgaagagaccaccaaacaggctttgtgtgagcaataaagctatttatttcacctgggtgcaggtgggctgagtccgaaaagagagtcagcgaagggagataggggtggggctgttttataggatttgggtaggtaaaggaaaattacagtcaaaggggggttgttctctggaggccagagtgggggtcacaaggtactcagtgggggagcttttgagccaggatgagccaggagaaggaatttcacaagacaatgtcatcagttaaggcaggaacaggccattttcacttctttcgtggtggaatgtcagcagttaaggcaggaaccggccatctggatgtgtacgtgcaggtcacaggggatatgatggcttagcttgggctcagaggcctgacattcctgtcttcttatattaataagaaaaataaaatgaaatagtggtaaagtgttgggacagcgaaaattttgggggatggtatggagagataatgggcgatgtttctcagggctgcttcgagcgggattaggggcggcgtgggaacctagagtgggagagattaagctgaagggaggtcttgtggtaaggggtgatattgtggggttgttagaagaaacatttgtcatttagaattattggtgatggcctggatacagttttgtatgaattaaaaactaaatggaataagagaaggagaaaaacaggtataaaaggtctaagtattgggacgactcaggacatctgattagagagtgcctaaggagattcagcatagtcctgccagcaaagattatttatttacttcaagagttaagagtggcagtttggggatagcatgaggagatgtcagctgtgatggcttggagaaacagtgtaaactggcagtgtaaacaagagcaggacatgtatgagtagttgagaacggtgaataggagtatgactagacagaagatagtagggatgacaagtttttttggggcacagtctaagttggtctggtgtctggaatgagactggggcctaataaaaaggagcgtctatacaggagctcaaatgggctgtactttgtagcattccgaggacaggcctgacttctgagaagggaaagtggtaaaagtattgtccagtcctttttaagttggcggctgagcttggtgaggtgtgtttttaaaagacctttagtccgttctacttttcctgaagacggaggaccgtaagggatataaaggtttcactgaatactaagagcctgaaaaactgcttggctgatttggctaataaaggctggtctgttatcagactgtatagaggtgagaaggctaaactgaggaattatgtctgacagaagggaagaaatgactgcggtggccttctcagaccctgtaggaaaggcctgtacttatccagtgaaagtgtctacctagactaagaggtattttagttatctgactaggggcatgttgagtaaagctaatttgccagtcctgggtgggggcaaatccttgagcttgatgtgtagggaagggcctgaataatccctgaggagtagtagaatagcagatggaacactgagaagttatttccttgaggatagatttccatgatgtaaagaaaatgagaggttctaagaggtgggctagtggcttgtactgtagcatagcctgcctttgctggtgtgtgatgattaggcctggtggaactgccatcaataaatcaagcgtgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaatcaagcgtgatcaggctgaggaacaggaaagaaggaaatatggggaaatggggtgaatgtcaggtggatcagagagatacagtcttgggtgtcaggtgtggtatcaggaataatgtgggaggctggattgaagtccgggccaggaacaatggtaattgtgggacttaacaaagagtgagtacagctgaaggagccgtggagcagaaagtatatgcgtcaggtatgaggaagaaaatagattttggaaattatgagaaatgtagagagtaagttgagcatagtttgtgattttgagggcctctaaagtattagggctgcagcagccgctgcacggagacatgatggctaggctaaaacagtaaggtcaagttgtttggacagaaaggctacagggtgtggtcctggctcttgtgtaagaattctgaccgcactaaccatgcctatgaaggaaaggaattgttgttttgtaagggattgaggtttgggagattaatcagacacgatcagcagggagagcacatgtgtttttatgagaattatgctgagataggtaacagatgaggatgaaatttgggcttgattgaagtaatgggggctatctgtgaagctttgaagtacagcccaggtaatttgctgagcctaatgggtgtcagggtcagtccaagtgaaagcaaagagaggctgggatgacgggtgcaaaggaatagtaaagaaagcatatttgagatccagaacagaataatggattgtggagggaggtattgaggataggagagtatacgggtttggcaccatggggtggataggcaaaacaatttggttgataaggcatagatcctgaactaacttgtaaggcttgtctggttttaggacaggtaaaatgggggaattgtaaggagagtttataggctttaaaaggccatgctgtagcaggcgggtgataacaggctttaatcctttcaaagcatgctgtgaggtgggatattggcattgagaggggtaagggtgattaggttttaatgagatgttaaggggcgcatgatccgtcgccaaggagggagtagaggtatcttatacttgtgggttaaggtcgggggatacaagaggaggacgcaaaggaggctttggattgggaagaggggcagcaatgagatgtagctgtagtccaggaatagtcagggaagcagataatttagttaaagtgtctcagcctaataagggaactgggcaggtggggataactaaaaaggagtgcttaaaagagtattgtctatgttggcaccagagttggagagttttaagaggtttagaagcctggccgtcaatacctgcaacagttatggaggcaagggaaacaggcccttgaaaagaaggtgatgtggagtgagtagcctccgtattgattaagaaggggatggacttaccctccactgtgagagttacctaaagctcggcatccgtgatggtctagggggcttccaaggcgatcgggcagtgtcagtcttcagccactaagccgagaaggggtcagtcagagaaccttgggccagagttccaggggctctgggagtggctgccaggtgagctgaacagtccgatttccagtggggtccggcacagatgggacgtggcttaggaggaatcctgggctgcaggaattccctggcctggtggccagatttctggcacttgtagcaagctcctggaggaggaggttctggaggaaggcctggccgctgcagttcaggcatttggaagttcttgtgtgctggagatgtggctggggttcgtctcacagtggaggcaaggaattgcaacttttttctattattgtacaccttgaaggcgaggttaattaaatcctgttgtggggtttgagggccagaatttaatttttggagttttatttaatgtcgggagcagattgggtaataaaatgtatattgagtataagacagccttttgactttttagggtctagggctgtaaagcttctcagggttgatgccgagcgaccatgaactgggctggatttttatatttgatgaaaaacagcctaaacgctatctgatttgggataaagaaaaaggagcattaaccttgactatgcctttagctctagccacctttttaagagtaaattgctggtcaggttggggagggctagtcatggaacgaaactgtaagccggactgggtgtaaggaggggaggtgataaaaggattatagggtggaggagcggaggctgaggaagaattgggacctagcttggcctggcgaggagcagtctggggaggaggggagaggtcagatgggtctgtagaaaaggaaggttagaaagactcagccacgcttggacgcttggggttgagactgaggggacaggtgggagggaaagaaggaagatttgggacgagttgcactgggcacagagactaggaagggaccgatgtgtaaaagaatgcctagacgtcaggcacctcagaccgtttgcctattttatgacaagaattatttagatcttgcaggatgaaaaaattgaaagtgctgttttctggctatttggaactactgttgagtttgtattgtggtcaagcggtattgcagaagaaaataagacacttagattttaggtcaagtgagagttgaagaggttttaagttcttaaaaacacaggctaagggagaagaaggaatggagggtggaaggttgcccatagtgaaggaagcaagcccagagaaaagagagagtagagacacggagggaaggggttcaggggttcttaccctccagaaaagtgggaaagaggttggggcatggaaataagggattggggcacagagatataagaggtcagggtgtggaaataagggattggggtgcagagataagaggtcggggcacagaaataaggtattggggcacagagatacgaggttgggatatttgcccctcccccagaaaagtgggacttgctgctaagggtgaaggagaagaggttgggggtttcttgccccccagaaaggcagagaaggggtgaataatcagagaggcgtccctgcaatgattaaacaccaagggaaggctccttcccagtccgtgactggcgccagagttttgggtccacggatgaaacatgtctcctttgtctttaccagaaaatgaaaggaattgaaattaagagaagggagagattgaagagtggaaaggagaaagtggttgagggatagtgagaaaggttggagaagagagtaagaagaggttgcttacccaatttaaaattggtgagatgtcccttgggctggtgggtctgaggacctgaggtcgtaggtggatctttttcacagagcaaagaacaggaggacaggggattgatctcccaagggaggtcccccgatccgagtcacggcaccaaatttcatgtgcgtccatgtgaagagaccaccaaacaggctttgtgtgagcaacatggctgtttatttcacctgggtgcaagtgggctgagtccgaaaagagagtcagcgaagggagataggggtggggccgttttataggatttgggtaggtaaaggaaaattacagtcaaaggggggttgttctctggaggccagagtgggggtcacaaggtactcagtgggggagcttttgagccaggatgagccaggagaaggaatttcacaagacaatgtcatcagttaaggcaggaacaggccattttcacttctttcatggtggaatgtcagcagttaaggcaggaaccggccatctggatgtgtacgtgcaggtcacaggggatatgatggcttagcttgggctcagaggcctgacagtgacgacatagcagtcagatttcccaaaccagaaatctgacctaacaaactacttttttggtgtgaattagcttatcttaaaaacttagaaaacatttcaattgtacctaggttctgaaaatcttgtctgtgtggttatgataagcataggtgaggtgctggttgagtatgtggcattcataaatttcagtcttcaagacatatatgtatgtctctatctctgtgtacagttatgattttatttctataattcagtttaatatctgactttactcccatgcaacttagtagtaagtaaatcacagtcactttgggggtccccccacctctactaattatgtaaaagcttctggggtcttacctagttccttagcatctggagtgtggccacccaggatgctttctttctctgtgcaaagggataactattgagacaacccttccacattcagtgggtatcctcagtgcttctacatcacacttgggcaactgaaatctttacaaggttttctgtggccctgcctgaatacagacaccaaagtctttctttttgctctggtcttgcccccgacctgggactctaccttgaaaacaggggtcagggcccctccttcagagagcttgcacatttctacttccttttatccttattccatcaggcagggaattctgaattagggaagtggaagactccatacttcctatttctcccaacattatatctgagggaacagagtcttccttctctgttccctcagtcactctgtccagaagatttttttgtttttttttctgcctcctgaccagtcacattctgttttacagagaaatctattttatagttaaattctgattttataatttaattgagtgtactagttcgttttcatgctgctgataaagacatacccgagactgtgtaatttgtaaagaaaaagaggtttaatggacttacagttgcatgtggctggggaggcctcacaatcatggcagaaggcaaaaggcacatcttacatggtagcacacaagacagaaatgagagccaagggaaaggggaaaccccttatggaaccattagatctcatgagacgtattcactaccatgagaacagaagggggaaactgcccccatgattcaattatctcccaccgggtccctcccacaacatgtgggaattatgggaactacaattcaagatgagatttaggtggggacatagccaaaccatatcactgagaagcatttagataaaaattaaatgcagaaaacatatagggtcggtagcagggaaggacggaagaaataaaataggttagtatgacaatcagattgatctcagtacccattgaacaaatcctgagcattgtaggagtttagaagaggaagctctaagggcttcaatgtaaacccttacttggttcctcaagagaattgtccaaactatgaaaggagaagaaggaaaaacaaatcaatataatgaagagagtcacaaaggaacaacataattatggctgaaaagttccaaaagcccagttcaaactggaaaacctgaaattatactagactctttcagtgtgttcagtgacatctctcggaaacatcttagagatatgagaagtattagagacataagatgataagatttatccagaagtgggaactgggatagccatatagaagaggactggggatgtgaagaaccctatgtgacccagggagtatggctttgtaatggatgatcaaatttcattgatgagggaaatgaaactattgaaaatatctgggaataagaaggtaccaagagactggacattgtgtagcggcataggagtgattgcattgatgtgacaagtggaagaggtgggaagtaaccagtttgtggtcagagagtgcaggatttagatttagaatcttggaaatcattctgaagattatgaagtagtaggtgtaactatgctgaatgttgaataaatgaagtagaggtgaagggcattgcatttgaggaagttaaagtaaagccagattcagagatgagtcattattgaggatgttagagttgccaaaaagggattatgattgaaaagaaaactgagccaatgctgaagtcatagaggagagaagcagtgtgaccggagatgtgatgggggcatgcgttaactaggttggggcatatcttcttttaaataatggattgatattaactatggctattttttctccatctatgatataaatatatatcacaaaaaatttgaaaaatatatgtaacaaaaattaaatcctctatatgcactcactcagaaaaacattgttaacatttggtttaccactatctcctgttttgtttttattttttttattgtttctttcttttacaatgaagcactggtactttaaaattatgttttggcattcagacaggtacagctttgcctttttctcgtatttaatggtaaatctcctttgtcttacaactatagacccctacattggcccaacaattatattcattatattcttggagactttaaaacatgtttagacattactatatttctgagaaaaaaaaatggcagcctgggtagagggcatggggatatccttctggtcttgctcattcatttacaacaagtaaaattatgcgagttagtcatcacaccattcctggagatatcctgctgaacatgataaaaaatatttatctgaactcaagaagtttacattctcctgggaaggatataatatcaagatataaatgaaaaggcaatattgaacttgttttagtaattatgatatggaactaaacaaggtgatataacaagaacctggggatgatggtggccatattgttcaattatcaagaaagaccactcatagaaggatgaagctgaagcataagaaagagcaatccaagtacaaagagagagaaaatagatttcagtcagaaggagcagcacctgcaaaggcccagaagtgtgaacttgttgtgttagaagaacagaataatgtctagtctagtgtatgaaaaaaatagggagaatgttacatcaaataggatctcattgaccattattagatttcgttctaagagcagaagaagggtactacagggtgttactctgaagaatcaaaagatcactcatggtaaatggtcttgttttcttcattgggaaaattgaagtagttagaggataatgcccatagactctgctaccatctacccacctaccagtattggcacccacatagtctgcatcccctcccattactatagattgtctctgttccaagttcaactctttcacttttgaactagattctcctctttcacatattcaaggacaaaactccagcaatttttttctctttcatccacttcatagttttcccttcactagtgggtcatcccatcacatacaacaaatttttctctcatttaaattactttaaaaatcttctcttgattctacttaccttttatctattgctacatttatctgttctcctttaccacaaaactttttgaaaatgttcttttattcactgtttctaattcctcttctatttccttataagcccacttaagtcaggctttagtgctgacaagttcactgaaacttcaattgtgcaattactgatgactgccatattgttatacccgatggccgatttttaattctcatcttatttcacctttaactcttaaaaattacttcctttgactttcaagacaccataatctcaatgttttcctcataccttactggtcactctctgtctccttggttgatttctcctttactcattggcctcatatgttggtatcccagggttttctcttttatatctattctcactccgtttgcactcctagccatctatatgatgatgacttaccaaattatatatctcaagccatgaactcttcctgtaattccaaacttctgttcaaatatcctgacaatctcctcttggttatctaactaacatagcaaatgtctaattgacattcattatatgaattcttatcttcccctccatgccttcctcaaccaataaaatggttactttatccttccctttgctcaggtcaaaagccttggagtcaactctgggtcttctctttcatactctacctacaatgcactgggaaatcctgttagctttgcctttaaaacatattcagaatttaaccatttcttacttgattattactggcccccacttacttgatattacaaatagcctcttcagtgagatgtattcttatgctcttgctcactaccatctatacgtctggcagccaggatgatactcatgaagtccatgtttgattgcatgacagctctgttcaaaatccttagtgtcttcctaagtagaacctcttagattaaaaaccaaaattcttacaaagacctacaaggcctgcatgaactgacccctcattaaatctctaatatcatctctaacttacttcttcctaatttgttctgctccagccacctcagcctccctgctagtcctcaagagtgtcaggcatgtccctccttccacagctttgctctgcttgttccctctcttggaatggtccaacccaaaaattcccataacttttacactcatccccacttcaggtctttgctcaaaatgccaccttcccaatgaggcctctgctgactcttaactattaaaattacccagaacttctaattctccttcctctgttctgtgttttctgcagcagttttcatgtaatgcagcatgaacatcttaaactccgttacacattcactttaaagacatgctatcttctaaaatgcaacacctttcttacccataaacttcataataccttggataatctagaggcaaaccctaactagggatggaggatttgacaagctcaactaaactatttctatttcaatcctggctcactagccattctaaccctctcaagcaacatgagaggtatacttgttctaagtatactcacttcccatcctgaccgccccctgccccagtcccagttgttatagaaacggacacttcccactccatggaagaatccgggcacggataacaaatcctgaactaattgcttcaggaagctccttccatctgaggcggatattctgggtgggtttagggcttaggtgatcatagtcaccttcaacgcatgcagtttataggggaaaggtgagtggggcactctgtgataagcagacactgcgatatgtgataatatgatgatgcattcttgagatacctaagtcctaccttgagatacctaagttccagatatgcaagtctgtaccatggaaacatacgcaagcaagcatcgggcctttttgaatggagtaacttcttcaccacctacaagttgggtagctaaatccccaccccagcaaagtagaatgtaagaaagaaggaaaacctatcccactccaaagagttcactggccaaagaattttgtagcatccaatctcggttgcggctgaccaagacaatctgatatggctattatatatttcaaggtcacgtggatttggccacatggaatataatttctggctggagcatgttctttcagaaagttggatgtgttctcagttgaaacactataggttttctccaattgcactgaattacccatcaggaattcctctaagcttggtgacctccttggttttgctcctgcaacgggacttagagtcaaatccccagcttctctttttcagggaggacaaggaattcagacagatgagaacaatgagagagagaaaggtcaccagagagcgaagatgaagagaacagaggaatggcagatacaatatgttagcatataaacacattataattttggccaagattggccctgtcggtaggagtttttctttgcataaagttttctctcagtaaataatagtctactctctcggtagcatctgaggccactgctgtaatgattttttaacttcataagtttcctagaacgttggtccaaatgaaggcaccccagttatgtctcagtcgtgtacctatagtgcgactgttgctgccatctctcagcagtccctggcaatgccacactgcttcaccatcagcttcaaagtgtccttgaagtatatattctgactacattgaatgggagtgccccatctcaacttgcaaccattggattcctgtaggatagaatttgtaaagaaaacaaggtttaatcaaaagcattaagagtctcttcttgttgacaactttttgttctaaggtaaccatatttactgtaaattatttttttaatctctcttctagtgacctacatgtttaaccaattgattgtactttgcatgaaaatcaaagtgttctttccccagtttacttttgttatcagtgcaatgcaaaatctgtttgcctgaattaggttgcatttcattaatctcttcaatatgaaattgtggtggctcatggttaatgagatttaagaatctgtgttacttaaattgtgactaacttattttaaaagtatgtcagaaaataatgattgtttctagtagtgttaaagtattaatgattagtaagtcttggtacacctgactgaactttggttagattaccaagtgtaatgaagtgttcaggatatttcagaattgagttagtatattacagattagtttaatctaatacaagagaatgtggtatctattagaaagacagacaatataaaataccagggaagttcaggggagggagagattctttcagcctagggcactaccctagtctcatggtcatctttcagacctagctcgtttcattcattaattattcattcattcaaacacacatattcaaaacctacaatgtgccaggtattgtgctacatactaaggatgcaaaatgaatatattaccattcctgctcttaaggtatttagtgtatcatatagtcatgacacagtgtttttaagtgttaagctaaaagtatgtacaaagagaaagagaagaggctaatagctccatcttgtgctggggtgacagcaaggagtgttagggacatcacaaggaagaaacaggcatctgcactgcacctcgacaatttgaaggtcaaataatagtcaggtggtggacaggagaagaatggaatctgacaaacggaattacaagctcaaagtcattgttacaagctatgtattggcatttcaaaggcaactcctgttgtcttcaaatatgctttaaaataatttaaacatctcatttatttttaaacagagccattgaactaagactaaacttagcaaatgatttacctggtcacagacgttcaagaaaacagtaaaactgttaaaatgaaaaagtcaaaacaagagtttgattgacacttgtctatttaaacataaccaaagtatatttaagggatgaagcatcctatatgttattgctattgatttttatggctatttattcatattttaagccttatcttaacaattctctgagataggactatagtggaggagtgaaatctcctcaataagaagtataatgctgagtaaattcttgtttctccctatcccctagatttagcagtatttacaccccaccagtttctactaagtgcatgcacacatgtgggctgtacaaacagttcctgggtcctactgtacacagcacagctgccaccagaacacgtggattccccagttctgactgtcctggattctagaactatacacatacagtaagtagaaatgttgtctctctcacatgctggttcatgcaagaatctcagtgagttcaatcaggggaggagcttgtgacataaaattaattttattgtgattaaatgcatagaagtgattagttcagtggatctgggaacctttgattatcacttgccagcctaatttccattttgtctttatgcaatcaggctgagctacataggtacacagattccatgcaaacttcaataaacaaaaaactgaccactttcatgactgccttgaatattttatgtttggggcattatttgtaataatttggaattagaaagtatgtatatctttttgagtatagtccaggaccttcttattcccttattacctgcagttgatgtcagaaaggaagtttcacatataggcatgttctgatgatttctggtattactgattcttgtccatttcctgatacctgaggtataaggtgtactattgtgctgagctaaaatctaataggtctctcttatcaagagttaatacttgttcatatttatctcttctggactcagttttcttatctgtaaaataagagtttagactaaatgaattctgacatttattcaagccgaaaaatattatgattcagatctcattgttccatgtctaaattctcctgttggcttcattgtgcccctaagccaagccacgttacttagccaaaaagatttcccacgactcaggtgtttctcagcttaacaatttcctgtctgttctatgacttgcccttctcatttccactgctaagttgtaaccctcatctgaaatgccctctgttcttccttctacctatccaaatccaatccatctgttaagaataaaatcttatgtatctaagtagtgtgtcacttcattcaagaagtcctgcctgattttttcagcccttccagtcatcaatttcactgttttctctaattacatattaaccctgtgttggattcctggattttccaggacaattatattattccctcttttccccatatctaagttctcagaagttctgcttctgaagtttttgttctacagcttaaattcaaaataaatactcgcttatacatttttgtattgttagctaattaaaattacaggtaaccagatggcaggagccatatcacatttcctttttgcccctcagaataggcattggataactacttcagtgttttattttaaatgaatcaattttgagatttatgttttttaaaaaagtgtcacaaatccaagttcaaatgtgtcctttgaaaatcctgtatattttagttttgacttgaatgaatgataataatgtattttaccattcccaggtggaaacaaccaagaaaaataagtgggattctggaacgctatgtattatatatgtcaaaccatacacatgattttacaatttggagtgtcatctataacagtacagaacttttccaggatcatatgctacaatacgttttacctggtaataaatatctcatcaagctgggagtaagtttatttccatcactttctctgtccccattccttccacttcttctccccttcccgtggtccatcttttctttctctctcacttaaaaaaaaaaaagtcaaaatcttcatgtattgctgtttatactgaaaactctcttcccatcctaaatgtgaattctggtgatctaatacctacacatttattttatattatgcaaatgatagaataacaccctgagtcagtagattttcccaagtcaaagttgggattatcaagattttcaaaattacttgtagaacatcataattgttaagaactttttctaaagtgctaggattcataaggttatttccctgtggcatttgtattcatttaaaaaacaatgcacagtatgaaaatttagatcttatatttttaaatggaagtttaaatgaccgtcaaatattcttgattgttattacattctggtttatattatgctcctatctcagaagaacagtcacttaataaaaccccagaatcaacatagtttagaggttcccttagacaaacaatagcattttttaaatgcaaaaatagcacttttacacaaaggtcttttaaaagaccttgatattactgtggaatttatactcagtaattccttttgttttttgatgaaatataatcttttttaagtttaatagcacgtctgaaaataactgaatataaacatgagattgtccctatttgttttaaacacactcttcattttatagcaatacctatataaggatatttgctttgataaatgccatagaaaatattctgctcttgattatgaataaatttacatttatgtagacactgtgtatgcattcattttacttaacatgctcttgaatgctctaaatattataccatgagaaaataaactacactcaactattgctaactgtctgacttaacaccacaaaacaagggcaatcagacagtggttaaaaaaatactgttcaaaactgactccatgtgcctaggtgttctgcacagcagtttatgaaacagcactttggttatgtacagttttattacccattaagtaagaaatatactaacttgattttcaaatgctaacacagaaatacaaactattttcaaaataatggtagtatcaaaattaggaagagtcttaattttttggaagcaaccaaaactaaaccaaaaattgtgctcttggttgtttatcagaagtaggcaaatgacatagaacagattctcttcctagggccgtttttaggatgtgctgtgcagtcaatcaattcatatcaatctcctagattttataaatctataataccttgaaaaatacatactagtagattaggagtcctctgccctgagtattaattcagattttactacaaactgtgtgacctaaggcaaattcacttaacctcactgagttttattttcttcaagtctaaaattagaacattgaactaaatgatgtttaatgtctctgagccataaaattctatgatgctaaaaaaagtaatcccaaacactattctatggagtcaaatgctatctgtcagccgctgaatagtgttgatgcaagatgttataaagatgtgaaaatccttgccttaactcttggtagggaaataaacttgctcacattattttcaagttcactatatttattagggcagaaaataatatattttcagggaggattcaactaacagggtttttacttaactctgttaagcagtaaattaaatgaaccagaacattttaggttcatcctggttaattgagggattattgtatatttcacagtttcaatataataactggctttcaaggtcattagattagtagatcgagagcaggttctcagcaaagtggagttgcctttatagatcattttagcatgtcgactaagagctggaaaacaaaacataaagataacaaagcctttaagcagcatttggaatagaggaagctacacggggatttgaaccactatgatttaccctaggcttggagcaggtatgttacttcatgtaacgtcatttagttttcacatttgactggattataaactgctgaaacataaggactgaatctttcaaaatttgatctgcagtttcaagcacagggcctattggaaatgggaagctgagcaaacaattcctgaatgaatgatcaccaaggacatcatttcataaaggttctaagacttttgatatgaattaaataatttgcttggaaacactggaattaggaatggtgtggttccaaaacatactctttccactgcaaaaaaaaaaaaaaaaaaaaaaaaaaaaaaaaaaacataatatgttgctactctcaacaaaggctattttgaaatgtgataaaatgtgatagctcctaataaagaagacaatatgttaaaaataaaataaagaagctattaatacagacagctatcaagacaggtgttgcttgataattttcataccactgctagccatttgtaacttgatgaattctaagtattatatattcctgaaagattcctggaagtggcttcactttttaagtaattatggatcaagtggcctttttctttttcttcgtgctttaaaatatgttgcactcttaacatccccaatccctgtggacctgaaaacttactggaaaagagaatgctagttttggtccgggcacactggcttacatctgtagtctcagcactttgggaggcccaggtgggcagaccagttgaggccaggagttcaagaccagcctggccaacatggcgaaaacccatctctacttaaaatacaaagaatagccgggtgtggtgctgcaagcatataatcccagctactcgggaggctgaggtacgataatcccttgaacccgagaggcagaggttgcagtgatctgagatctgccactgcactccagcctgggcaatacagcaagactccatctcaacaacaacaaaaaaagagaatgctagttttggattgtcttaatagtcatgatttcaaaaataattgataaaattttattatttatgcattttattgtaccaaaattgaatcccttatttggccagatgttactcatcatttcaaggcagagttatgcctttatgaatttttcaaaatggctgtaactgagaaaagctataggcgatggttaaaacaacttattttaatggctctcaggctttcaaagaccttgctatttcataaaggcatttttaatcaaccccactattttgtttagtttttccagaccagaattttaatcagcattcagctgtattgaatgtagtggcctctggtgcgggcaggtcaaacaagatactgattggttcaatttcatttagatgatgtcagattagaccaattggaagcagctttaagaacatttattttcccatcaaaggaactaagataatgtcctgcttacttaggaccctctaaatgcatccaaaaagaatgtgggcaaaacaaaataaaataatttgcaggtaattctgttatttcagcagcctctttataaataatttcatttacaagaaaaatgctttcataaatgccttacattcttaagagatttctttgtcaagttactggtttatggatctcagatgacatagtagatgaaacagtccttctaaaccaaaggatgcttttacttatcctagaagacatcataaaatcctcaaagtaaattttaattcacactgtgttttaaaaatatatacttatatgttgtatagtatagaatttatttggggagagttagcaggggaaatattttagtatacaaataagaaaaaaatagtgacaagtagactatcagaattaaatcccagtgtgttacaagtttaacaataagaagctgcaacatttttcccttctaaggaaaaaaaatctgaaaaatgcaaatggatggattttttttctccctgagaagtgggaaaaatttgtctttgaccatttttcctttgataactcagctgtctcatatggcctcttttcctgccatattttctggtggacttttagcacatttgaaatgtctggggtcttcaactttttttctattttaatcgttgggcaattattttttgagctcacagtgacctgtcctaaagctttgagtcagagtttggccacatttgcaaagattccattctctagaggagtatggtttttttcttgcacagaaaggcacatgccacagctgagaattagaggaaacccacagaggttaattaggtacccaatcttaatgcaattttcatgctcaggccacaatttaacccatctgaaagttgcttaattaagctggtaagaaattatcctgaagacatgggctattgctatagtcttgtaatagcaagtgagattaatttccatgtttgttgaccataaactgttgtttatgcttataatgaagaatttgcaactagttgcaacaactttgcaaatagtagtgtactcccatatttaaaaaaaaaatctaaaaatcagtcagcttccttctgtctttggggaaaagaatatcgactactttaagaatcacaaaatcactcactcagtatcaaactgaaaaatcagagagacgcctaaagaaagagatgctttaattttttatcttagtaatatctgtcttacacaaaaatgagctaaatatctctgcttttttacattgtcttatgattttgctttattttctttttgattttggtaaaatttagtgccttttgaaagatttttaaactttgttgtatcaattgaaattgtaacttgaagagatactgaaccaagcttaagtatagttttcaaatatcattgttatataaggatataattactaatatttgctagcaaatatgggctgaaaaccccttaatgtatttatcaatttcctggagaagtgcttgtccagtaagtttaaaacattatttgcagtttattatgaaattgcacacggaagtttctgtaacattcatgttaccatttctgacattagtgatacttaattagggaacagagagttctgtgatcatgttaaatttgtcaaacatgttttaatgaagcctatctactctgacacataagtaaattatgtgatcctttaagccattaaacattcactcaaaaattgctttgtatttgttgttttatgagaaacattgttttatttaattttatttggtgttatgctataaacatattggtcacactgtagaaataaaaggcaattgtatttgctgcacatcttttcttccctagaagtcagttgttttgtcttaaagtagtcttcatcctctagtactttacttatgttatgtgtacacatgctgtgtgtgtgtgtgtgtgtgtgtgtgtgtgtttaattcactctgggaacctttgtgcaaggctaacttcagcagggctgtttatccagtcaatatatgccctacatctctaggctctgacttaagatgcttccttaattcatacattcataccatctcagttattctctaactattggggatggctatcttatgtcttaaaaagcaaattaaataaatgttaaatcttaacactgaaatgaatttattttggggaagtaaaggtagcactatataacaaaatctgaaactcttattatgaattctctttcctcaatgttcatgaaaacttttgggaccaagagtgaaatgagcatttttgcatctctgtttaggcttgcacaggtggtgggtgcacagtgagtgaggccagtgaggccctaactgacgaggacatacccgaaggcgtgccagcccccaaagcccactcatattcacctgactcctttaatgtctcctggactgagcctgaatatccgaatggtaagtgaactcttttagcctcaagttaaaaagatgattagcaaaggtaaattaatattctaaatggcagcttatatgtggtgcttaatttttaatgatcattttagcacataaaatacctaagatagtatcattgtctctagttggggagattgtggtttttaggctaacacacaattttggtggctcaaaagtgctcccttttgatagtttttgtgtactgcatctcattgtttaatatgctccaggagaggtgaagagagcaaacggggaggattcccaaagaatgccgtagtgagagtgacattgtattttcaatgactttctgtttttaaaagccattagttcttccttggcgaaggagagaggtggaaagttcatgtacatattgtgtcaaaacgcttttgatttaataagtttatcttaaaagaggccacttggaactctgtattttttaatatactatttataaatatttcaacatgctgtttttaaacaatgcatagattaaacatacatatatttatacatatttagctggaggcaagttttgtgcatttctaagcaatatatatgtttttgtacagtttagtgaattaagctagtcagttacgtttcactaaaataaaatctcattatgaagaatttgtaatagttttgggtagaaattgctttattcatttagtggaaatatctttaaggttcatataacatagtaccattgtttcacactgatggaagcttacttgacattaaatttcattcctctttgagacaaatatcaagaagacttttaatatagaaactcttttaagaaactcattactgaaaattgaaatgggctcttttagcacagccaaaaagaatgaaagaaaaaagttacagttttattagtttgtcttatgtttactatgatattaattattccagccatctcattttaattaaacttttggcaaatgcactagatatatttgaggtaatggagagaattctaataatcagagtgaattattatctctgctattgaagttattcctgtactattacaaattttccaagaaaaaataaatggatgcctatttgataccatattaagcaatcaacaatcttgttatgcttcttacttcacaaagtaccctagttcatagatgacaatgaaaatgttaatgatttatttcaattggattgctgtgaaatgctgttacatgatttgcatagtagagcacttcccttcatcccaattggttaatacaactagaactacaattgctctcagaatcttcagctgttcagggaaacattttccacattacaaagctctttgaatgttttgtgtatttgcgtatgttttgtatatttgcaagcagttttaaaatgtactcatcaagcaagaagaatttgggagattttggagatttgtattgacacttccatggtattccaaagtcttgtgtttaattagagtgggatttttagaactttaattgtggtacaatggttagacatttaaaaggcagttttattttttttaaaacgactttttttgtttttactacttctccccactttcccccaattttttagctttttgtttctcttgttgattgtctagagagggataatctgattgttggaaaacatcttgtctctccatctgtcttcgaagtccccacacctctcctcaaatacccaaagaataaagtctaaattttttagtctggtattcaggttactaccaacttgtgactcaacctgaatacacattgccttataacatatcttcctttctagccatgctggaatatttatggcttaatgttgggttggaaaacatgggtggagtcaaataggcctagagtcaaaaattgtttctgatgtatagtgactgtgttacctcaggaaattcattaacttccatggaccccaatttccttgattagaaaattgagattaacaggctgggcctggtggctcacgcctgtaatcccagcactttgggaggctgaggggggtggatcatgaggtcaggagatcgagaccatcctggctaacacagcgaaactccgtctctactaaaaatacaaaaaattagccgggcatagtggcaggtgcctgtagtcccagctactcaggagggtgaggcaggagaatggcataaacctgggaggcggagcttgcggtgagccgagatcacaccactgcactccagcctgggtgacagagtgagactccatctcaaaaaaaaaaaaaaaaaaaggaaaattaagattaacaatccctgtcatcaccctgtccttacctgtagaaatacaactcattcttctaggctaaccgtaggcctcttattccatgaaatcattctactcttccttaagtttaaagtaaactttccctcttctcttgactatgtgaactgtttctatgccttcataatggaacttcattcagcctgtgcttaaagttatttgcgtatatgtcaaacactcccaccagatgctaaggaccataaatcattaatttctctttcactccgcagagcctaacacaatgttctactttttattggtacgcaataatatttaattcatttaatgtttcttgtggaaattacctttgatcagtggcatatatactccaaagccctggctctttaatgataccaagagagatgatagaagtacttaccatccagtgtctgcaatatatttgttcaaaatgcatttgttcctaaaatatatttttctagctgtgtagattctgaggctgggtttctcttttgagaataccgatcttgcatttgaccaaagaatttttaattttcttttctggattatgcccaattcaaagttaatggtaccaggctcacatggcaatatatgctacctaatggttgctttctaatttctgaatatgctgctgaagagaaatacaattggagaataagatagacttcattcttgtgtaactaaataaaccctttcaaaagattttaaatggtatttctcaaacttatctgattcttagaacaatcttgggagcaccaattgaataagtagattctaggctccaccacagacctcctaaataatcagaatcttccactgcctcggttatcatcaaaatacccctgggtatttactacattttccaactgagacctctcacaaaatcctccccctggatttttgttacatcttaaacccagcatatccaagttgatttctcctcatggtctccatctctctgcttgctctttctcctgtattccctctctcatggatttgcaccacccagccctgccagccagtatactgggcagcagtcttcaccttaaaccttgctcacccctgactgctgtcaccacacaacccctcgactgcacttctctagtgaaggccattaatattgctcacccagatcgcttcaggagcctcctcatgccatgcaaaaaatttgcatttgttcattcaaaatatgtattttgatgacctactaggttccttcactcttatctatacagtgcatttccttgcttcttgatctcaaggatatcagagtcctcggggaaaatatccatataaatgaattctcacaaggtggggaggtgcacaaggtgccaggtacacagagaagcagctcctagtggttccctatgagatgtggacatgtcatccctctgcatcctcacgaagatgttgcaggaccagatatagacatgtgtttagtctgaaacaggtattacttgcctggttttgcacactcaggtttcaaaatcttgactctgttaatcagttatgtacctaaaggtatgtttgttcactagggatttataaacatgaacaaagacttgttgagaaaaattaaactcaatttctataatgagaactaggtatatttttatgcttgcctatatatgacaaaatatgaaaggtataaaaagttctaatataaatgtccagtccttgccaatcaaacaattggtagcctttggccagcgtggcttaggaaacattctgtccttgtcataactgattctgacttaaatgatcatctcctactcgtgaaagtctgatggtaatccttaaccaatgctttaagaaaagatcctctccccttgttatttcagttctcttccttgtctcccagcctggtcctgctccacagtgtctgtgctggaaagcttgctagttggttcagtacatacttcatgagccctgagaatttttcctaatttggtgtcttttgttcagcagtgtaccagcagctccaagaatagtgcctgagacataataattgctcagttaaaaaattgttgattaccattattaaagaaaaaaacagaaaacaacatgttctggaaaggatgtggagaaactggaacccttaaatactgttggtgggaatattaaatggtgcatctgctatgaaaagtagtgtagaggttcctcaaataattaataatagaattattagatgatgtagcaatcccacttcttgaaatatatccaaaagaattggaaacaagatgcattgcagcattattcacggtagctacgaggtgcaaacaacctaagtgtctatggacagataagtagataagcaaaatgtgatatatttacacaatggcatatcactcggccttaaaaagaaggaagtcctgtcatacaatatgctctggatgaaacttgaggagattatggtaaatgaaataagccactcacaaaaagacaaatactgcatgattgcacttacgtgagtttatctatagtagttgaatgcacagaaacagaaattagaattacggttaccaaggtctgggtggaagggggaaatggagagttgctgttcaatgggtttagagcttcagttttccaagacgaaaaagttctacaactctgttgcacaaccacgtgtatgtagataacacaatggtacacttaaaatggttaagatgcccaattttacgttgtgctttttactgtaataaaaaaaagatacagagaggatgtaataaaatgctataaactaaactagaaaaaaagattaagaacagtgttagtttaaaacaaaaaaaaattgctgattaataatcacatagagatctatgcatgaagtatgcattttttaaacaagggtgagctcatactatttgagttgttgtggaatttacttttctcacttcacaatatggtgcaaacatctttccttgcagttcagtggaacgtgacctcattctttcaaaaggcagtatgcaatcccactgaatgaaactacagcttacaagacccatctttttattgatggacatttctgtggtttttgctattacaaacaaggttacttgctattaattgcctcagtctgccaagtacagtctttaagtactgagtcattatcacttgattcacacctaaggctttgcttgccttcaaatatgtcctgcttaattctagtcccttgcttcacatacctgcaaaaatgatggtgtgacactccagctctgtttctctaatcagagtcctttgcacccacgttccctctggcaaaggtgttctttacaggctgtgatttcagacatgattttaaaaccgctgaaaagagcgacttttaggtccaaggtctataggaacccttattatgtaggaccttgacgcttcctttgtaagaccattagctatcacagagaagtagcacaaaggattactgtctaatacatttgtgacctgtattgtgtagattgcaattgcgtaattaaagttctgcttttgagagcttccaaattctcatgagccatattcctttttagaagcttaggccttagaatcctgaaatatgttttttcttcacacttcaagtctaccttgctaaaacagcatagctatctgactatgccaaacttattcgtcattatctagcataacatttacagtgacattttaaactaattagaatatgtgttttttttaaatactaactaaaaatatagaatataaaatgtttatcttttattaatagctataattccttgtaactaacctctatctttacctaagtaaatcgacctaaaatagtttctttattagactgagccccatgagggcaggaatcatatgtatctttttcactgccctagtcctggcctttggcagagtgccacggagtagaggcatcttataaagctgtcgaatgaattaatatttaccgatgatagggacaataccaaaattgtaatagtgttgatgtgagaagcatattcatatgcaatcatacaacatacacaaatgcacactgtgagcacatttgatgattatgtaatataggtgggatgatttcaaagacagcagagaggaatcttcctcttggcctgctgaaggcttaaagcacacacttagagacctagtccttttgcttaagatttcatcagcctggtaatctgtagatttcctaatgaaagacagcacatagacttgtcttgtttgtgctctgcatgtctcagtatgaaaggatatgtttttactgtggtcaggatttgttaataaccacatgggcataattaagagagaagcatgtggctgggcgtggtggctcacccctgtaatcccagcaatttgggaggtcgaggtgggcaaatcacctgagcctgggagttcaagaccagcctaggaaacatgatgaaaccctgtctctaccaaaaaaaaaaaaaaaagaaaaagaaaaaagaaaaaaaaaattagccaggcgtggtagtgtgtgcctgtagtcccagctacttgggaggctggggcatgagaatcgcttgaacgtgggaggcagggtttgcagtgaaccacaattgtgacactgcacttcagcctgggtgacagagtgagaccacgtctaaaacaaaaaagagagagagggagaagcatgagagctgggcacccattagacatggtctagcatcttcttgagaagtgaaggggacctgagaagcttatggaaatattttcctaatttagtctttcatattggcccatctttgtgagaatttatatgtgaacatatgtcaaaatggtggcaatcatgtcaaaaataatagaaacatcttagcaggttgattatttttgtagacttacacgtagtaccttgaagacaatagaacgttatttaaaaaaaacatttggctcagtgttttgagcttatatattctgtcaataatgggtggtagagaaatcaattaactataggtctcttatacacactctatacatgttgtccttcacattaagagatgatgctatagaaataagttttcataatgtatgcacatgaagatatatgtataaatacaaattaaatattctatgcatgcatagaaataaatacttgatttcctgttaacaataataacattagtaataataataatagctataatttataagaatttgccaggcactttaattcccataactagcccatgaaataggtattgttatctcacaaatgtggaaacttagatttataagtattaaacagtttaattattcaaaatcaagacagctggttaagcagaaagattgtataaatcaaagcaaggtgtgaatgacaaaaattcacggttttattcactatattatctgcctctactttttgtagaaaggcttataatgtagaatttaatctagctgtatgaaaacaaaattttgttacttttacttgttcaatgtcctgttcttagtgccaatatttaaaattcataagatctgtgttctggtttttctctggttttggagagataactgtttgatatttcatttgattttcttactttttattttaaaataactttatttttaaatggtcaaaatgtgattctattttctttcctggaaatgctcagttttaataagtgaaatggattatagaactcagcgaatcacttaggaaaactgcttgacagttttgagcaaaccttgcgtaacttttatgaaacacctccagtcagtttgtcaggtagaatttcccaagcacagtcttttttagattccgttgattccatttttaggagagcataacagtaataaggcattatcccgcaatgtgaaagctcttctctcttttcctttttaattgaaggatcaagtattcacacagggagatatctgccacattcaatcagcatctggaccttgaggggagccctcagttcatattcctattgccatgctgcactggaaaagacaaacaaatatgtttggagcatctatattcactacacatgttatttttatgacacactaaagcattgttgtttaattcttacagtaaacacaattcttcagcgtaaatagagataccttgtattaaatttacattgtattgtacttgcattgaatttccttggttatatatgacaacctattgagcaccttaggaaatacaatttgacataacatgatgaagaggcacaaagatatatatcccagtggatatgctttatggacaattatcatccagcttccctgtgaaaattaaacaccttaaaaaccctatcattatggaaacagaaaggtgataaacttgaaactccttctgttgtacagccaatgggaattaagtatccattttgtggattatccattgaagaactgaatgtctagaactagattaaattaaactgaattaagccagaacctgaccccctttgccacatggcatgttacagttttattttgcttcagctgtcttactgattattagtgccagagaataagcaagaaaaagcctgaaaaaatacaatatggtacaatataatagagtaagtgattttttatggtgaatatttctcttttgcttttctagattcactctttttcaactctgccccgtgccctgtaaggctgaaccttcctcacagtggcaatgggcttcctctctctctggcttcctgttggtttgtccatgggcagcaacggcaaaagatgagagggtgagaggagcatggagtctcagaactcattctccctggctctctttctgcatggctctggattccagggttgcattcctccagtaaaggctacatttcctatttgaagcctctttctttctccaggttcctgaatttgttctcaccctttcctctaaaaacataaagaagtttactggctcctagccaactagttaaaatggtctaggaatcttagctagtactagctgggaatgctttattgtcactggttgctttcccttaaccctgtccgcatctttgtaaataggagttccactaaaatcttttccatgccatttgagttgtcattggtttcctgttgaaaccctgactcattcctaaattttatttaatccacatttaacacggagaggtgttttttgtgtgtgtgtgtttgtttttttgatgggggggtagtgcgtgaagataaatttaaaatgactttcttcatgctaagagtggcaagaataaataagtaaatgaacaaaatttccattttcttaaactttgtttcaatacaatagacatcttaaaggccaataagaagagccaagctcaaagattctagtggcggcttgcttatctaataaacccatcatatttaatttttcaaataataatcaacttattgatatatctttgaaagcttttcacttattgttataaaatatttctttgttatcattagtgaaataatggcttatgacatcttcctcttgatgaagtagctctgagtgccaagtttagcttataggtcagtttcggccaggcgtggtggctcaagcctgtaattccagcactttgggaggctgaggcgtgtgtatcacctggggtcaggagttcatcaggagttcaagaccagcctggccaacatggcgaaaccccgtctctactaaaaatacaaaaattatctgggcatggtggcaggtgcctgtaatcccagctactctggaggctaaggcaggagaatcacttgaacctgggaggcggaggttccagtgagccgagagtgtgccattgcactccagcctgggcaacaagaacaaaactccatctcaataaataaataaataaaattaaataaaaatcaaggtcagtttctcagataagccctattacgtatcctacccagactaggttagcatccacctctcccttctctatcccatgttttccttctatccatctgatttttaaaaagtaaactttacatcctcataatacctctaatgtctgttctttcgcttagattgaaagttttgtgaaggaagtaaccatgactgttctgacaacttctgtattaccagcatgcaacacaatgtctggctcatagtagctaccccatagttactgatgagccagatgactaccagaaaccaaatctaaatccagcagacttacaaaaattattttacagtatttagtaaatacttgtttctttgcactttctggacttcattggaaaggaatgaattttaaatgaaaagatagcatacaaatataagaaactattggctaatgacagatagtgtgccacggaggaatacagacctgcctaagcttgtttttgagagatgttagtttagtttttacaagagaagtgcagcacatgacataggtcagaattggaggagatagtctaaggtgagcttcctatagcaagtaaaactttaactcatactagaagcaaggggacagttctgtgtgtgtcccttctatgtgcacagtgcttattactaaagcacattcatatatgctcacttgtttgattctcagatcaactgtcaggccaccagggcaaggaatattaccccattttgttggtcaagaaatgaaagcttagtgagttttgctatctaaccaagttttaaaggtacgtggtcatgacagaagggctgaagtggttggaggaagatccctgaaaaagaagacaattggcttggaagcttttgactttgttttgaaatagttcccagaacaggagacgcactcaagaactaatttgttgattgaatgattacttacgtaaatgtatatgcacaaaattgatacttcaaaataattggccatacaatttatcctgttctgcaacttgctttttttctctaattcacatggagtaaacatctttttatgtcaatagcatagtgctccctcatttttcctcaaagcttagtaaaatgccattgaatgaaaccacaacatttatagaggctatctggtaaatgattaatatccattccttgctacagctacatctcattaatgccagctaaccattaattataaaagatgttgacaataaggtttggtgcttggactagtagatagtcctcaaatggattctcatttatttggatttggtatactccttgaggtagtgttgcaaggagtgtttagccaatagttatatcctgaggagtcctcaaggcctgaggagaggaccctgaactagctgttaagcctcctcctctaaaacaaagtcaaacaacagggttgaaagtcaaagaatgaaagagaaaagaaagctgatgtgcctattttaatatcagacaagactttacagtgagtagtattattagttataaaaatgtagtttcataataataaacgagttactaaaattaacatttattttttatcaaaatatactataagggcccacaaagataaataataagagagatgatatttagaacacatgtaaccatcagaaaactgtatccagaatatataaaacatgcctacacatctataacaaactggagttaacatctgaaaagtcatttcacaaaagaagaaaaattaaatgtctgataaacataagaaaatgggccaacttctgtaataatccaaaagtaaaagataatacccaaacaagataccattttttacatctaatactggcaaaaatttcaaagtctgacaataaggtctttttgaggatatagaacaatgagaactcacatggactcacatgtacactagaattgacatactttcaaaaagagatgagcattgtctagtaaaattgaacatatatcaacaattcctctccaggacatttgtcctagaaaatttgtgtatgcgcttcaagacacatatacaaaaatgtgtataattacattgatgtcatagccaaagtataaaaacattctaaatatctatcaagagtagaataaataaataacatttgccctgtaggaatactacacagtaatgaaaatgagtgaagtatggctactctcaaaaacatgtatagaacacatgaatatcatgttacacaaagcaagatgaaaaaattatatatacaacataactctattaatataagttagaaaaccatgagaaacttaattatgttgttaagggatgcatttctcagtagaaaagcaaggacatggttcttcaaaagtcctcatatttatctgtgaggaagggaaagggatccaattatggacaggagatttctggggtgctggcaacattctattttttcaacgtgagtgatggttacatggccttttgcttttaaatttgtcattaaaatagaattgatattgtatatatttttatatgttatgttttattacgtgatttttaaaatgtagaaagaataggtatatggaagccgtaaagttgtatgcactgtagagtctgaatgcttcagtgccgacacatagctctaccacttcctagctgtataacactggccaagttaccaaacctctctaaaagcttttcttgtcatctatttctctcatctaaaatagaacccattccactatcaagagtttttcctgaagattaaatagtacttgattaaaacgctcaatccagtgattattgctttagcataaacttctttggactttaaagtgtttgtgtcttcttacctggcatgctcccctgcacaacagtattttttaatttaaatattttattttgagataattacagattcacaagaaattacaagagacagagattccatgtatctttaattcagtttctcccaatgtcaacatcttctaaaactataatacaatatcacaactaagattttaactctgatataatcaagacacagaacaattccatcacaagacatggtttcttcttatcctcacactgaaaaacaattccctttttaaccaggaacagaagggtaagttagtactttggaagtaggcttttatgagattaacgtcattgttcatgtttgataaaggaacactcttttctgaatagtgattttatcataccatattgcaatctaacacattccatccctaagtgtcacaagttttttttttaattaaaaagaaagtatatataactgctaaagatatttcttctgccacagactactgctgaaatgcagcattcccacatccctgcctcattcacgactacttcctatacattcaggaaaagacgtctttaataattatttttcctgtttgatatttttaaccatctcactgttactacctgcatgggcttccctactccagtctattttacatgtgattctagattattttttctgtatatgactttatcttgtcgctagtcagttcataaaaacactaatggtctcctgtgcatcataaaatcccaactccttgtagtgtcattcaaggccccaaattccctttgaagttttgttttctattagactttatcgagtgatatggtttggctctgtgtccccacccaaatctcaccttgaattgtgaaaatccccatgtgtcatgggagagaccccgtgggaagtaattgaactatggggggcatgtttttcccatgctgttctcctgatagtgaataagtctcatgagatctaatggttttataaaggggagttccctgcaaaagctgtcttacctgctgccatgtaaaacatccctttgctcctcctccaccttctgccatgattaggaggcctccctagccatgtggaactggggagtccattaaatctctttcctttataaattacccagtctcaggtatgtctttattattagcatgagaagggactaatacatccagctacaggaataacaacagattattgatctatttgggatacctttactgaaccttgcactttcttacttctaggcagtggcaaatgtcattttcctcaccagaagcatcttcctgagacataggtatttcacatattacctttcatgggagacttagcttcatcatatgacttattgaagtccccactaccgtatgtggaagacttgactgctctaaaaagcctgtaacacttctttagccagagtgattattccctgctagagggtcctgtacctactgtctactatttaattatgtcatttgtttggcataaagttgttgtggtgcttatgatccttgtttaacccttgaattgttatttaattatacctatgtttaactcttttcttacttccataaaggtagatattattcttattctgttcttacttcccaaaataccaagtatagtactttgcacttgattgactttcaatatatttatattaatctttttattaggcttatcttgattgctttgagaaccagagcatgttcaccagttcttaattcaagtgaaattcctaaaaattttagaagaggaaattagaccagaaacatataacaagagtagtgaccagagtggggtaagatggccagtttccacaactaaatttatatttgtatggccctgtaaaatgggttagcccctctaagaatccattccctcctctttacagcaatgacaacaacaattcttattttttggagttgtcagtgttaaagaaaataatgcataaaagcatgtaccctattgtctgtctcaaagtaagtgatcagaacattttaattttcttttttaagaaaggctctcactttgtcacccaggctggagtgcagtggtgcaatcatggcccactgcagcctcgacctcctgggcctgagtgattctgccacgtcagcctctcaaatagccaggaccacaggcacatgtcatcatgcccaactaactttttgcattttttgtagagacagggctttgccacattgctcaggctggtctcgaactcctagactcaagcgattcacttgccttggcttctcaaaatgctgggattataggcatgagccaccatgcttggcctgagcatattttaaattactttaaattattttgggctggtggcagtggctcatgcctgtaatctcaacactttgggagactgaggagggtggatcacaaggtcaggagttcgagactagcctggccaatacagtgaaatcccgtctctactgaaaacacaaaaattagttgggcgtgatggcgggcacctataatcccagctacttgggaggctgaggcaagggaatcgcttaattcgcctcctgggaggcggaggttgcagtgagccgagatcatgccactgtactccagcctaggctacagagatagactccatctccaaaaaaattaattaattaatttaaaaaattattttaagtattctataattttgaaaatacttacatggcatttcaaggactcaaaatcttactttccccagagctactcataaatcaaaactttgtttaaaataaatgaaaacagaggtacaacataccaaaatctctgggatgtagcaaagacagtgttaagaggaatgtttattgtgctaaatagctacctcaaaaagttagaaagatctcagtttaacaaactaacatctcacctagaagaacaaactaaactcgaagctagcaaagattttttttattactgattcaattttcgaacttgacattggtctgttaagggttttaatttcttcctgattcattctttggaagttgtttgtttctaagaattttctctgtattttctagtttgtgtacatagaggtgtttataatagtctctgaggatgtgttttgcttgtttgttgttgttgtttttggtaggaactgcctcccctaccccgccgaaaaaaaagaaaaaaaaaaaaactggaccaggtggattcacacccaaattccaccagatgtacaaggaagagttggtaatgattctactaaaactgttacaaaatatcaagaaggaaggactccttcttaacactttctatgaggccagcatctctctgatagcaaaacttgtcaaagacacaactaaaaaaggaaactacaggccaatattcctgataaacatagacacaaaagtcctcaacaaaatactagcaaaccaaattcaacagcacagcaaaaagttaattcaacacaatcaagtaggcttcattcctaggatgccaagtttggctaaacatatacaaatcaataaatgtattcataaatctccttgagttggaaatatatttaaaaacatgattcatcatataaatagaactaaaagcaaaaatcacacgatcatctcaatagatacagaaaaagctttcaataaaatccaatataccttcatgataaaagccctcaacaaagtaggcatcaaaagaacatacttcaaaataataagagctatctatgacaaacccacagccaacatcacacagagcaggtagaagctggaagcattctatctgagaacaggaacaagataagaatgcccactctcaccactcttactcaacatagttctggaagtccttgccagagcaatcaggcacaagaaagaaataaaagaaatcctactaggaaaagaagaagtaaaactatctttctttgctgatatgattttatgcctacaaaacccaaaagattccaccagaaagttcctggaactgacaaacaacatcagtaaagttttaggatactaaatcaatgtgtaaaaatgagtagcatttctatacaccaataatgttcaaactgagagccaaatcaagaatgcaatctcatttacaatagccacaaaacagtaaattcctaggcatacatccatccaagaaggtgaaagatgtctacaaggagaactagaaaacactggtaaaagaaatcgtgtatggcacaaatggaaaaatgttccatgctcatgaagtggaagaatcaataatcactaaaatggccatagtgcccaaagcaatttacagattcaatgctatttctatcaaactaccaatatcatttttcacagaattaggaaaaagctattctaaaattcatatggaacccaaaaagagcccaaaaagagccaaagcaattctacacaaaaagaacaaagctggaggcatcacattactcaacttcaaactatactataaggctacagtaaccaaaacaacatgatactggtacaaaaacagacacatagaccaatggaacagaaaagagaatctagaaatacagctgtgcacctacagctatctgatcttttacaaagtcaacaaaaataatcaatggagaaaggactgcctattttaaaaatggtgctggggtagcttgctagccttatgcagcaaaccagacccctacttttcatcatatacaaaaactagctcaagatggattaaagatttaaatataagatctcatattataagaatcctagaggaaaacttaggaaacaccattctggatgttgtccttgggaaagaacttatgaccaagtcctcaaaagcaattgcaacaaaaattgacaagataaacctaattaaactaaagagcttcagcacagcaaaataaactatcaacagagtaaacagacaaattacagagtgggagaaaatattcacaaaccatccatttgacaaaggtcaaatatccagaatctataagaaacttaaatcaacaagtaaaaaacaaataacctcattaaaaagtgggtaaaagacatgaacagacacttctcaaaagaaggcagacaaacagctaacaaacatgctcaacatcactaatcatcagagaattgcatatcaaaaccacaacgagtaccatctcacaccagtcagaatgactgctattaaaaagtcaaaaaacaacagatgctggcgaggctgcaaagaaaagggttgaatgcttatatactgttggtgggaatgtaaattagttcggccactgtggaaagcagttgaaggtttttcaaagaacttaaaacagaaccaccatttgacccagcaacccattactgggtatgtacccaaaggaaaacaaatcattctaccaaaagaaacatgcactcgtgtgttcatcacagtactagtcacaagagcaaagacatggaatcagcctaggtgcccatcaacagtgggttgaatgaaaaaatatgatacatatacactacgaaatactatacaaccacagaaaaaaccctgaaatcatgtcttttgcagcaacatctatgaagctggaggcttttgtactaagcaaattaatacaagaacaaaaaaacaaatattgcatattctcatttataagtgggagctaaacattgggtattcatggacataaagatgacaatagaccctgaggattaatggcagggaatggggagtaaggactgaaaatctaactgttgggtactatgctcactatctgggtgatgggatcattcacatcccaaacctcagcatcacacaatatacccatgtcagaaacctgcacatgaacccccgaatctaaaataaaagttggaaaaaacagctattgatacatgtcctgtgttctagttaaagaaaaaagcatcttcttaggcttcagtttaaaatgtccactacattatatttgttagtttttgttactctgtttaggaatctgaggtcaatgaagttaaaattgtcatgttaataggtgttttagacttaccgcttattaaaagtatgttttaaagctgaatcatacagtgttttatattatattgattttgtttatattgaaatcagcttaatatgatgtgtgtgtgtgtatcaatataatactagtcctacagtgtggttccacaattcatccttcagcccttcctccatatgctgtcaaatactgtttacctacaggatgccgggtaactctgtgtttgtgtgtgtgtgtgtgtgtgtgtgtgtgtgatctcacctatgttaaagttagacttcattctcatccacctctcaattagatacatcctggatactaaaaagtttttgagcagttgaattaactgtcacaaatatcacttaatttcattctcagcttatttgccatgtattcatcttagtctaagcccttctttcaataactgtctgctcttcctatatccatagttccagatgtcaaggttatctagcttctcaacatagattgctaagggttgacttactagagtcagatagacaaaaaaaaaaaaaaaaaagaagaagaagaagaagtaaatttggagaaactgtcactgagagaggatgtagaagaactcaaacaatgacacaagaattggtaaggtgcagtcactgagtgatgtttagggtaaaagctgggtaagaaccctgtatctcatcaatcactgaagcattatagaattagagaatgtagtctttggtgtccataatcaaagtttcagtcttcacaaaatgattcaattatattcattatattctgtgtgagaagacaggtaagtgtgtagaacttactagaaggatttccttcaaaagtggttaagatttttagagttcatacttaaggggatgagatttagtttcaatgaaaattaacttctataaaatatctcatttcccaatatgtcagataaatgagatattatgcacataatcctaacataaaagacattctctgttccccaattatgtaagaaaagggaactattgatttaggtactttgtatctcagttaaaaagcaggtcaaataggtagcatttcaagggtcttatggtttctttaagagattctgtaacacactatttgtacataagatttttttaggatcaactgactgcttcacagagagcctgacatgtaagaattttttggtcattgttattacctgatcatatcttttttccctttaaattttctatgtattataggtaggtggtgttttcactatgtgtctttcacttcttagctttaactcatttgtgtctttgtgtgtcaagtactacatagaattaaatcaaataccttccataggtattcataaagttaccatagatggtcacaccagaaataaagaaaaacagatactggcagccacatctttttgtgtgtttagagctataagtggtacctgagagtaaaataaaagatctttcccaaaaatttggaaataagggaaatggacttatcagaatggtaaactatacaaggttgtcttcttaaaggaaaatgaatcacagcagtggctttttaaaagtattaactcatttaacaaaaaatgctttaatcctaaatgaatgtattgtcctagatctgattggtataagagaaaacatttcagatattcaaaacagagggtattttatacaagtaggttgttctcaaggtgttgtaaagaagggctggaagaacaaaagggaaaggtggcaggtactggatggaagaaaaggatgattgacaggagctggtgcttactgctacacttgccgatttgacatttgaaccattatgggacgctgccccaaccagagctgaaatgccaacaacattccactaccgaagaggcagaaaatgcagaagagatgcttcttctgtctggaatgcttgaggctgcaggtgctttgtcccctgctgacacagcagctgtcaacaaagccctcagctcttggagctagaaactggacgttttctttcttcctgcttctgtcctcctcacagtgcctcccactggcaaaacccaatagaaggccaacaagcaagagagttggaaatgtagtttgtagtttgtaggttcagccgtacagaacaggctatagaagcgtggatgtgtagctggggcggacgtcagatgaatcaccttcttagctactcggcattcacacacacccttgtacttttcaccacctttcattaccaatagcaatcactctatgcttccaatgaacatgatactactatgctttgtacaaatgacggtgctctcacctccctcatcacattcttatctgggtgatgttaattccccttttagttcaggcacaacccatctggatattcttcaacataaaaaaactaaactataaattaatacccactaaccctatttacatgaatcaatggggaaaggaggacggaaaattggctacaatatacaaatctctgtgtcataagcagaaataaaatatgatagcatttataattcttgtttatataattagttgtgagaccatagctgatatttacaacttcttctctttgccctcagctggtagttcatttgtttgtagttcttttatttttattttttgtagagatagggtctctctatgttgcccaggctggtcttgaactttggggctcaagtggtccttctgctttggcctcccaaagtgttgggattacaggtatgagtcaccacacccggcttatttggaattttttacttaggccactggatcttcattactaagggggtctatgtccttcctgttctatcttgattgggttgctgcagattttcaatgcttatatgattggacctggtcatataaagagatgcccttttgaatgtcctgactgacaatgtgcagtaggaagccagtttctcctccaatatgataccttttctctttgcctgttataggaatgctatgaagagagggttaaaaagaagccaatgtgtaccaggtgcttagaacagtgcctgatacattatgagtcatatagaatgcattaacaaataaggtcgatttacttctggggcatatctattaagaatatcttcttttagaaagcaatacaaattataagtatgcttcacttattaatttttgatctggaacacacatgacaacagttaacaggatgcaatagaaagattctcatgctggaactgttgggttctatttctgtctctgtattaattaggtttacagtttgatattcaagggtaacatctattttatcctttggtaagagacagagtttagacaaggagaaataccagagtctgtgatttaatgattccatgaaactagaaatcacatcaagagtgcttgctttcttaagaccttctttgctattgtctagtagtcatactgaaaggcaattattatcttcccaggtgttatcacgagttatggattatatctagatggtatattaatccacaattcctcagaactcagctatcgtgcttacggatttgctccttggagtttacattccttcagagtccaagcatgcacggccaaaggttgtgctctgggcccactggtgagtatctaaatttacattctaggaatgtgttaaatgtcagatgacactgaatattaaggaagaagtaagtggcggtgactcaccctctgcacagctagcctttcaagcaggatgggagatttttctttttataaaagttcatttaagagttactaagattttatattcgacataaatttcaagactgaacataggtccagtgaagggcagagtctacattttattgaaagaaagataagttggctagtgtagtaggcaaacatgaaatttttcctaatttagtgacatattgaaggcagatgtttttctttctaatcatgggctcaacatctaagtaagtttaagattaagaagtaaaaataattgaaagtccataagtgccacaatatggcaacactgctccccaaaaagtaatcaattaaaaggttgagtttacctcatctgttaggataaaatagtttcatgtgatacagcttcataagaatggtatttaaaattacatcaatatcagcttttgatattcatatttcagaaatctatatctgaaatgtatatctatatttcattagcagttaacagcttgacaagattatgttttctattcctaatataatttttcaaacccaattaatagcacttaattatcataaactagcaggacagtcttcagtttcaaaacatcacattacactttggtgcatttttcttgattaattagattttgcttctttagatggaaatgctcattagtcttagatattttttggcaatgtttgctaatgccctatcattttagtgcatgctgtcttcactgaagagtatattatataaatattaccttggaagacagctctatgttttaatttctgcttccttatttttgatcacacctctctttttgtttcagagattggttgctttccaagcagctaacaccatccatcggcggagctgagctgtagtctttattgccattaagcattttatagcccagacccctctgatggatacttacccttaaatgcaggaatggcaataggccagcttttcttatccattcaaaaaaaaaaaaagaaaaagaaacaaaagaacacgtcacatgagattgaaatttacactttttgaaaatgtaagctgcaaatggtagttctggctacaaaattggctcagcggtgtctcctgatgttctggcaactttaaataagggggacctgcattatcaacctgcatcctgcacagacagtagctacgttaaccttaagaaatcaaatgccacaaagctctgataggaaggggggaatagaattgggttgtaaaacctagtctgccatggcttcattcattccagactcaatcctgacttacagcacagagttattttctcccttggtacttttctttatgctgtactcagtatgcaaacgcttttccctagtcaatgatccatctctaatcactgggattgaagagcaatgtctttatttagaacaagtcaactatatgctaccaagaagttaaagcccatggtcttcaactggtttgtgaaatatttttgtgcccattaagtgattccatatctgagtattctaaatagccctggatggctagcacaatcatgaaggatattacagattcagcttctttttgttgatgattcttttaatgtgtccttattgacttaagaaatctatgaatcaatcttaaaaggcagagttttctatcattaaattatgatgtgatactcaacaaaattcagtcaaacgtggcaatggtgtacaacggtttcttaagatattcatctaaatagagcccgatgctatgacattttaaataaaaaatttcattgaaacagaaaatttatcatttctatttttaaatattttgctggcagaaatcagaataaattttgaaagagttcaatttttttgttcatctaatatttcttaatgataattcttgttctttagattatccacacatgcagggaaatactattcaatgttttctatgaggaatatgcttcacagtcccaaatatgatatggttcatcctccaaattgcaaattgttcatataataaaaaatatgaatttgatggagaatttttaaaaataaaaagacatacagaagttccatattcttaccacttgaatgtagtattagctcatttttttttctaatctgaccagtttgttagctattatttatggttcagaaggagttgccctgtacctatctggaaaaaacaaaaacaaaacaaaataaacagcagcaacaacagcaacaaaaaaaacccacaatgattctcctgtggtttttttcagttcttactcaaccaaataatgtatttgactcttatggaaatttcaatatagaaaacaattgacaaagcctttgaacctaatttttagatgctaatgtgcattgtcaagttaaattcaataaattggggttttataaattttgaaataacataaaaattaacagaatgcagcaggaactttttaaatgctttccttgctttcaattgtattagagggaaacccttcacattttgtaatattctttaataaaatacaataatgttttccataagaaaatcactttgctttcttactccccacttagccaatgttacataacactagtggagtctaagattgagaattttatgactgtgtcttgtattgtaacattcattggatcgattctccagggactcttaaggatgatatgcgagactataggtcattgctatgtgatatggctaaaaagttgtcttggttccttagtgatgtcatacttatacagataaatacacctggataaatacacatgtacaaacacattcaccctttcacattttttttttttgcaaagaagcaaataagtgtgttatttaagacatctaaatcttaatggcaatatataatatagtcaagcaaacgctataggggaagtctgccttcaacctgcttaaaccccttaaatccctatacccccttaggagatatacttattctacaaagcctcagatttctcaactattacaaagagaaataatgtctactttaagagagttggtgtaaaaaattaaatataacttacacaaatttctggcgcattgcaagagttttattaagaataacagtttatggccaggcatggtggctcacacctgtaatcccagcatgttgggaggtcaaagtgggtggatcacaaggtcaggagttcgagaccagcctggccaatatgatgaaaccccatctctactaaaaatacaaaagttagctggatgtggtggcgggcgcctgcagtctcagctactccggaggctgaggcaggaaaatagcttgaacctgggaagtggggattccagtgacccgagattgtgccactgcactccagccttggagacagagtgagactccatttaaaaacaaacaaaagaattacaatgtattaaagtgtttgtatgttttattgcacatttgctctcaaatattttttctgtgtcaagagaggttcccaggccaaagccaagccaacttttacctttcccaagtgccttttccacatattccttttacagcaaggtagataaacaaaaaagtaaaatgaaaaagaaagaccaggtcagagcaaaatagtacaattgccaaattcaatgtatagtaaaaactgaagtgtttatccaaatatttaaggaaatgttacaaaacatatttattttgaattaaccaaatatttgaggattataatataattatctggaattgcccttaattcttcaacttttcaagtctcattttatttggaatgctttaaaatcattctatgtacaataatatgaactatatagataggcataataaaacaaattacattgtcataaaatattaaaatgatgaattgatatttttctggcctagtttcatcatttttgtatgtagctattaaactaaaaacgaaagagcaagtgttatagttctaaagaatcccatagcttttctctgatgaaaataaaacatgttgtgacctcatagttattaaaaattaacactttctttttcacatttattttcataattgataaggtataatcaccctaacaaataaaggttttctaattgataatatttctgcctaaggatttcatgtttgatcacctccttgggaggcaagagcttgtaccttaagaataaagttgaaattatcacatatttagtaaattgtgaaaggtcaaatatctatgagtgatgctgatgagtttgtagtgattagttaactgaatttaagctaatgattaaaagatattaaaaatttctgaactcttttctactttcttgccaactacatcttcctctgaccacttattttacttatttatctattgaaatcttcctgaccccggtacagctagggattgcattttatttcagagtctttctcttcaaataattcatcttttgctcttttctgcatagcttcattaacacaatcaatatttttttgtgattgtgccttagggatagagtccctaggatgcatgtatttcttaatgttagcatgatgccatttttacataactgatagcaacatagctcataaaaattttgcgtgtgtgtgcgtgcatgcctgtacacacatgtatgcatgcgtgtgtgtgtgtgtgtgtgtgtgtgtgtgtgtgtgtgtgacagagaagagagagagtcaagatatgtggtgtagctttttgacagaggccagaagtctaccacctaagtcaaggacttataaaaacagactgcgtgcatttcttctcttttgcaatcacataaaaattattttaaagcagtcctagaattggtctatggatatgtacagccataggcacagtcacagtgtgagcagatccacatattctggaaatcacaaatagctgccttggtcaagagctcaaattctaagctttaacagcagggggaagaaaacatgaggtgtgctttgatcctgctgacaaaatgaggtattcatacaagatgctactgtcaaaatagtttacttcacagcaaaaagagattctttgaagaaatatgctcaaagcgaagcatgtacttattttatttgcaaacaaaaataaatctttttatactcacaggtggaaaatcgaactctagaagctcctcctgaaggaacagtaaatgtgtttgtcaaaacacagggatcccggaaagcccacgtgaggtgggaagcaccttttcgccctaatggactcttaacacactcagtccttttcactgggatattctatgtagacccaggtaatttgtttttattttctaaactttaaataacattagaaaacaactcatttttatttaaaatctttcttttggctaaaatctttcttttagccacagatgttggtttctttattttcctgaaaataacctatacggataagctactgcccgacggttctcagaatgtggttcccagagcagcagcaacagccacatctgatgaacgcttagaaatgtacgttgtagagcttctgccccagcctagtgaatcagaaactctagaggctaaggtctaacagtctgtgtttaagcaaaccctttaggtgacacatgctgaagaactagtatatactcttcttcccttgctaaaaagtggttcaaacctaaaacatcgtgtatgcaaagagttgaactataattttgcagtccatcttaaacaagccatttttgtgactgttttagatttctgaactatcttagtaattctgctgtgtgttctgataaatttactgaatgtggattaggctacatggggttccttgaaagtattttcaaaaactatctgattcaataagttaggtgctatggtagcatgatgtttattttaagcaaactctaccataaaaagagcaggtatatattttaatagaaactttggatctgtattaagtgctgttgtttatcatcttccaggagtggccttactatttttgtaggaggaagtttgaacctttatttttaaatgagtagcaaatatgcaatatcgtggattcagtcagacatgttattagcatgttagtctgttgcttaggcttgaaaacgtttctttgtttctgaattttctatgagtctttgtaatacttaataacatcctccaagtgtaaaaacaggtgaagaaagaaaaaaacaggcttttctaaatttgaaaagggtggttatttgtgtactgcactggcaagcaaatgcgagtcaagtgcgtgtcagagtctaagctgatcccctcaaagattggtgtgtcccttttttatgcaatcagggctttcatgtattctgctgtaaagcacttgtaagattatgaggtgaaggagtgatgatcgatttgaaaaaagaagcaacatttaggccggacccatgacagcccagctatttccgccaaggcagctgggtgaataatgcaagagccatattccccctcgtgtttaatcttgcattgtttttgcagagaaaatttctgcttgccttctaagtcatgtcatcttcagttgtcatcccgtctctcaaaccatcaaaacggtattaaatgttgcaaagctgcgcggcaagagaactttcaaaagtcagaacccatttaccgaacagcccttgtagaaaatgtattctgttctcggcagaattttccttcagttctttccactgagaagtttactgatttctcccagtggaatctgctggaatttatcggttcatggttggcagtcacagattaaggtaaatgtcgatccgtaatgaccctctacatgttagtattgcagtaaagctgggcttttatgtcaaagatatcggagagggagctattacacatgacaggggtgatcaagggactccagaccaaggcaagcattattaaatattgactagttctgtgatttatgtagagctggaggaaaaaagtgactttttaaccattatatattcttcagcaacgaaaaccagccatttatctcctgctggtaataaagaacagagtgcctgcatattttagtggagggaaaacctggtcttataaatgagatgaactccttcgtgataacatttcagtttgttaattgccaaaagcaaaacagacaaattggaagcaattacgagatttgacttaaagaatttttgcggtacgggttcaactcaggggttggaaaggggtgaggttggaagcaaaaggagcatctgagatgggccccaggaaaattcgtgtcattggttcactggcactggaactctcatgtccactgttaactgaaaggattttgaatattgtcttgtcctgtcacccatcagcagctgggtgacatttacactgagggtagggaggtctgcatggctctacaagaacaaattaaacattaattcatcaaacttatttaagatatcatctgttcactagatttatacaaagcttattgaattgtctaatggctaattggttatttccttgacataatgaacaactgtatttcatcctttcctgtgatggctgctaaagagggggtggttagaatttataagatagggaaattcagctagttcaaagcaagtgtagtttcaacataaaagtgcctgcagctgggtcactattttgcaggagaaattgggctgtgtctgtaagacaccctcatgggaaccctattcttcatgtcaactcgtatcctgaactaaaaactttacaaaaacattaggtttcgtaacaacaagtgaagtggcacgtatcaaagtgtgatttttcttaaaaattgttcacttttgaccacgtattatgttctcatgaatcaaaatttaaaagatagaaaaaaaggaagtaaagtaccaagcctgttctgcagtctcagaggaaaagtagtgtgctcagcttcttatatccttctagaaatatttgtcttataggtgtgtgtgtgtgtgtgtatacataaacaaacacatatttcccccatttgtaaatacatatagttttcatctcacacatgcaacattttatactaatgataccaagtggtacacattattttgcaccatgctttttttccatcttaataatttcagagaaattatcacagcaattcctaacgagcttcctcattctttatatagcttggtaatattcaacgggttagagcataccatcattggtttaaccagttccttattaatggccatttaatttgtttctaatcttttattatttcaaataatgcctcaatgaataaacatatgggaatgtcctttcacactttgcaagtaaattaatacgataaattccttgaaatgaattgccaggtcaaggaaaaatgaatttgtaactttgtaagatactgtcaaatttcattccatagagaccatataatttatattctcagaaaaagtatgagggtgcctgtctccccacagtcttgtcatcagagtgttgtcagacttatctttgccaattcgatatgttaaaaatggtagctatttcacagtatcttgagtagttattaggaattagttggaacttatgaacatattttcttaagtttaaaaactgtgtttcttttttttgtgaatgcttcatttgtatcttttgcccacatttttacagaggtttaagaagttctttatatattaggaaaatctgttatattagtagaaatttttcccttcattattgctttttcctagcactctactgctttcttttataaaatatttatattcagttcatctgaaatttatactgatataatatgtcatgtatgggtcaaaccttattttcttcccagaaaattttcctttctctcaaaaccatttactgaataatccttattgttccccactggcttgggttgtcatctccaagagctcctaaatttccatctttattaataaatacgtgtggacatatctgtacctttatttacattatcaaggtatcttaatgattaaaactgtagaatatattttattgccttgtagatctagtcctcttcattatttttattttatataatttcctacttattatttcatatttatttttttcaaacaatatttatatatttctaattttaccccagaagtcctgatgctgtttttataaggatggaacagaatttacaggtgacttaggtagaattaatatctttatactgtcgggtttttctgatcaatgatatcattatactttctattttgtgtcttttgtgtctctcgcaagagctcaaagttttcttcatatagatcttgcatatttctgttgtgtattcattaatattttataattatacatgatttaagtaattatgataatatatacattttacatattaacattaaaattaaataactgaaaagagctactttcaataattatatgtagacttcactcgcagatacctgtcttctgaaagccacgattttaaatgtttatatctattagatgatcgttcatctaacttttacaaatatttgaagtttttttgctgctaagattattgtcattttctctaaaatgcaggcatcttaccaggggaaaatgataatctaattaattagactctcaactagtttgtggtgtgtaaaatggcaacaaaggttggacctgaagaatctctgtcctgacagaatttacaaataaaaaagctaaggcagacaaacttagccaagttattctcaagtgcatgaggcaggaaagaaactagatggtgtgacaagtggaacagaaataattaagggaagattttggtaatactgggtctttctctttaattatggatgagaataaactgaatatggaaaaactaaagagaatgacggagagagcacaaacacatgtgaatggcaaaaattaacagatcaaccaacctacacttggttatattagaatgtatttttgccatttgctaacatccaccataaaagtaaggattagcacttttctatgggattctacctgatttgaaacatctattcaattatgaggaacatatgatcaacaaattagtttttctagggtgtgcaagtgccatttactgacctggaataagtgctttgctcaatgactctcaagggtgcaccattcaccttgcacaggtgaatagtcaactcccagtgatcactttacaacatcttcagtattttttcacacatatgaattaactatcaatttaaattatagataacaggtttataatcattccttgtgaaacatattgaatatataatttttaaaaaataaaacaaatgtgtaagtttgggaatacaaataaaactttacagcatagtagtagcaacctggcttatgtaaaactatttataaaattataaattctattccatttaactggtagatgaaagtattgtgccatgataatttagggttacatcattattttacagagcttcaaaagtattctcagctacaaatataaaacaacctaattgtcaagaagaaaaataaaaactatgaaaagataaagaaaatattctgagatcctatagaataatttttacaaatggcagcttctttactactagacttcccttggattcttcacactgatcctgtacttagtagacaatgccatgtcttagtacacatatcctgcttttttcttaagtggttattgtggagtcctctgcgaattgtttaattcttcattatccttccttttgaatgaattgggacgtgatcttcattgcttgatatcctgacagattgctttgtgtcagagtttctaaggcaaggcaccagcgtgtgctaattgctgagtcctttgtgcactgttaactctcacctgctctgaaaaactggattgcagcttagttttcatcttcaaatgtctctttctcctaatcccctattttgtgctgtgccacagaataaagatatttatttgaaaaagagagatatggattactgtgggggaaaaaagagggtaaatgaaaatgatccttaagcattagcaaagggaaatggcattttagaaaaacaaaagaaaagcaaagcagaatgatcagtttttaatgttgaaactgaatcatttcatggatctcagataactctttctgaatgtggagaggtacaacaaacaggttttaggtgacttttcccagagtaaatatgtctaatccaaaataagtcctcaaaagtaagggtggaaggtaaggaccgggaaagaaaggaaatggaagatagaaagaacaatttttaaattgttaaatgctcatgaaatgagcataatcagatgctttttatttgcttataagacctgatggtcctgaaaaaaagaaacccaattagtatttaagaatgtttttaaaaaggcaaatgaaaatttgggaaatatatctgttatctctaggtggttatattatgaatggtttgtcttcccatttttccttttatatgtactcaacttaaaaaaaattctataatatatacatattatttttgcaaaacattataaaaaatagctcacaagagcagatgattcaagagcagagtaatttggagtaagcatggtgcttctggctccaaggaggagatccgggtggtgagtcagaagtcctaaggtggaagcttacagaaagaagggcatcttcacatatttccaatgattattcaggaaaagtcttttggtgacttgtgggatgttaaatttaactttcttcttatgttttggctgcatatgtttttccaacagttgctaggggtaatcaaacaaaaacaccaaggattctgcaaaacagaaaagaaaactaaataggagtggtcagagaaataaaagagcctctttatacctgagacataatggtagtgttaggggaggactgaggcatgggagatttggtttttttgaggttacattgtggggatcaggaggggcataaagtttttactgcagtggtaacatctggaaggagtggggtgccttaaagaccgattaggatatttccaggtagaaaagatagagtataaatgtgatggctccccatcccccattctctgagcctaaactttttcttctgttataattggagtccatatctcatttcaatattggtatcaagtgtttgctctttgggataaatccccatctaaaaacaaaagaaattaaaggggaacggaaactgcagaaatgcagaaagtatttcattgctggtttaaactagatgaaagtgtatttttaactacagttccgaaaaatcctagcacccagaataggcttaccttctcctggaattgccagttaccagaaagagtgctttagaatgtcagtatattcaaatgctctaaatctctaaaaaatcttgaaaaaccaaagaaatgcagttgatttttcaaggttacccagagaaatccagtgtccttttcacacactctggttctctgggtgcttttctccccagaatatactgtgttttataaaaattacaagatggaaaaaaaatatacagaagcgtttattttcttgagaaggtaaggaaaataattatatgtgggaacctcttagacttccaaagagtctgtaggaaggctaatgctgttaggaaagggacagctttgttttatagtccctggtatctgttttttagtgtggagggaaatctgcggtttcagagctgtgcttgcaacccatgcagtatatctgacacgctgccctctgggaaaacccgccagtgggggaattgttccagtgatgcagtacagcttgtaacttggaatcccgtcggagaactttgtagttgcttgtcagtcagtgggaagataaaagaggcagcttcttttcaagcaatctgaattcattttcccgtaatgagttagggggtcaggcagcaggagtgagttcacctgagatcttataaagtatatttcctggtggaagaaagagaggaggagaaaagggaacataacgtccaccacgcagctgtagaacggcgtaatgtggcttgtcgttggtctatttctttttatgcccacatattctgatttcagagcatatatttttagaaagaaaggtcaaagaaagtacagctttatctcatttaaaaatataaaacccaatctgtgaaaattgaaacccagttaaagtctaaagcagcaagtgatagtgtttcatacacaaatactcatcaagcaacaacatgttaaagatattgtactatgtcttctgacattacatcattattaaccacacaatttattttagagacttagaagaaattaaatgagtgtcatgataaggagttcttttagttacagacaacagccccagacctctcttcctgaccatttcagatgttgtttctaaatcagcacaaaagatattaggaataaaaactgtgggagaatgttcttatggtcaaagcaagtattaatataaaaaacattgggaatgtaggggaaatagagaaaattactctgtttctatttgtttggaagcaaatgtctcttatgcaaaaaagaaagtatagttattatatctttctgtaagtttccaacacatttctggatgtataaatacatacaaatctaaacacttgggaaatcaaaaggcattttttctggactacaaattatggccatattgttaatgaaaatataaacgggcaataataagatatctgtcatttcaaatattgggctatagaatgtatatgcactgaatgtattgacacttctgattgtatatcatgtcatggccaataaagctatagaaatgtttaattaggacatattcttccacaagaatggagttaagcattaatttatcaaacttgtttaagacctcatctgttctcaacactcacacagcagcttattgaatttgtctgatatctaattggctattttcttgacataatgaacaagtgcatactctatgctgttgtgtctgttgaggcggcgatgtaatgatgaaatggaaattgtaaccatgggtcgtacactgattcaggatatgcagcccacagagccatgagagggcacaggatttcattgtcctcatggcttaactttatgtttcaaactctgcagagcatctctgtggaggaatctctccattctaactcctcatgaaaggagcctgttagaagcaaaatacaatcagcagatcacccagatgatgtacctttggctttggaaggctttgcataatttaaaaaataaaataaaattctcctatttagagaaatttttaaagcatttaaaaatactcacaccattttcaaacccacaccacaagtgatttgggggatttctaatacatgcatgataaagttcaactggataagccagccgtggggcagatatataatgtttacctatagttgtgtaccactgatatgcctgtctagtgttggtttttgcatgctttgttgtggcaagagttcagtgcttgttgaataaatagtaatattagaatcagtgtttagattttggtagactgaacatatagccattttacctaggaggttctcagtaggaaagtgtcagctgtgaattgatgttagagggaaacagaagaatggattacacagagaaatagaaaaaaaatctagccatctggggccaatgtccttctctagcctctaagacacaccctacagcaaggaattcccttctctgattcctgaacttctcctgtgggaatctagggatcaacttccttggatggtgatgggtccttatcattatacagagttatgaggattacaaaccatatgtttggccccttagaaagtgataataggtgactcctaaatcatagttctatataccaagaacagcccacatcaaacatatttcccaaatttttgtgtgaaattcttcataatcaatgtgttactttactcaattattagtgttgcagaatctaaggattctagtgggctatttatgaaaaaaaaagtatatggcttttagagaatttggattctttatttataaatcgggttgcaaataaaatttatgtttttccttctagcaatatgcctttggggagaagcaaagggagttttacacccaagaagcagaaatcaaaaatcatagaattaaattaagaaatttatttgtttatttggacattcattcatttgttcatgtagaaagcatgtatctagcttgttttatggaacaagacagaaactaaatgatagctgctggagttgagtagagaaattttctctatccagagttgaatcatatgttgttttattgtgctaaatttgttagacatttaaatttatacgaatgatggtgcctgtttctgggatatttattccttcccattgtaaacctatttctccaaatcatcactatgctaacttaatcactatgctttcaacatctgaaacatttagaaagtacttaaatatctggcaagcatggtctgtgtgctgaaggggcttgtggtttaacaaggggagctagaaattacccaagtaatcatatagaaatataaaattacagactttaataattattaaagtaaaagtatatataactaagattttcataataagaagcttaatataaattggagggtcaagaaagtttctttgagctgatgacatttagggtaactgtaacatgactagacaccaactcagaaactagaaagaggattccaaagtgaatggcatttgtaaaggatgtgaggaaggtaaaattgtggtggatttgaggaaatgaaagaaggacattgtagctaggctagggagtgaagaaaagaatggcacagatgagactagaaagttagacaggagctacttcatgcagcagactgttttaaggactttggcataaagtaaaagtgtagttgcaataattacaaaaaattttcaaattttcaattgtttttttttattattattatacttcaagttttagggtacatgtgcacaatgtgcaggttagttacatatgtatacatgtgccatgttggtgtgctgcacccattagctcgtcatttaacactgggtatatctcctaatgctatccctcccccctccccccaccccacaacaggccccagtgtgtgatgttccccttcctgtgtccatgtgttctcattgttcaattcccacctatgagtgagaacatacggtgtttggttttttgtccttgcgatagtttgctgagaatgatggtttccagcttcatctatgtccctacaaagtacatgaactcatcattttttatggctgcatagtattccatggtgtatttgtgccacactttcttaatccagtctatcattgttggacatttgggttggttccaagtctttgctattgtgaatagtgccacaataaacatacgtgtgcatgtgtctttatagcagcatgatttataatcccttgggtatatacccagtaatgggatggctgggtcaaatggtatttctagttctagatccctgaggaatcgccacactgatttccacaatggttgaactagtttacagtcccaccaacagtgtaaaagtgttcctatttctccacatcctctccagcacctgttgtttcctgactttttaatgattgccatcctaactggtgtcagatggtatctcattgtggttttgatttgcatttctctcatggccagtgatgatgagcattttttcatgtgtcctttggctgcataaatgtcttcttttgagaagtgtctgttcatatcctttgcccactttttgatggggttgtttgtttttttcttgtaaatttgttggagttcattgtagattctggatattagccctttgtcagatgagtagattgcaaaaaatttctcccattctgtaggttgcctgttcactctgatggtagtttcttttgctgtgcagaagctctttagtttaattagatcccatttgtcaattatggcttttgttgccattgcttttggtgttttagacatgaagtccttgcccatgcctatgtcctgaatggtattgcctaggttttcttctagggtttttatggttttaggtctaacatttaagtctttaatccatcttgaattgatttttgtataaggtgtaaggaagggatccagtttcagcttctacatatggctagccagttttcccagcaccatttattaaatagggaatcctttccccatttcttgtttttgtcaggtttgccaaagatcagatagttgtagatatgcagcattatttctgagggctctgttccattctattggtctatgtctgttttggtaccagtaccatgctgttttggttactgtagccttgtagtctagtttgaagtcaggtagcgtgatgcctccagctttgttcttttggcttaggattgacttggcaatgcgggctctttttttggttccatatgaactttaaagtagttttttccaattctgtgaagaaagtcgttggtagcttgatggggatggcattgaatctataaattaccttgggcagtatggccattttcacaatattgattcttcctacccatgagcatgcaatgttcttccatttgtttgtatcctcttttatttcattgagcagtggtttgtagttctccttgaagaggtccttcacgtcccttgtaagttggattcctaggtattttattctctttgaagcaattgtgaatgggatttcactcatgatttggctctctgtttgtctgttattggtgtataagaatgcttgtgatttttgcaaagatactcctcgagaagagcaactccaagacacataattgtcagattcaccaaagttgaaatgaaggaaaaaatgttaagggcagccatagagaaaggtcgggttacccacaaagggaagcccatcagactaacagctgatctgtcggcagaaactctgcaagccagaacagagtgggggccaatattcaacattcttaaagaaaagaatttttaacccagaatttcatatccagccaaactaagcttcataagtgaaggagaaaaaaaatactttacagacaagcaaatgctgagagattttgtcaccaccacacctgccctaaaagagctcctgaaggaagcattcaacatggaaaggaacaaccagtaccagccactgcaaaaccatgccaaattgtaaagaccatcgaggctaggaagaaactgcatcaactaacgagcaaaataaccagctaacatcataatgacaggatcacattcacacatagcaatattaagcttaaatgtaaatgggctaaatgctccagttaaaagacacagactggcaaattggataaagattcagacccatcagtgtcctgtattcaggaaacccatctcacgtgcagagacacacataggctcaaaataaagggatggaggaagatctaccaagcaaatggaaaactaaaaaagtcaggggttgcaatcctagtctctgataaaacagactttaaaccaggccgggcgcggtggctcacgcctgtaatcccagcactttgggaggccgaggcgggtggatcatgaggtcaggagatcgagaccatcctggctaacaaggtgaaaccccgtctctactaaaaagacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccagcctgggcgacagagcaagactccgtctcaaaaaataaaaaaaataaaaaataaaaaaaataaaccaacaaagatcaaaagagacaaagaaggccattacagaatggtaaatggatcaattcaacaagaagagctaactatcctacatatatatgcacccaatacaggagcacccagattaataaagcaagtccttagagacctacaaagagacttagactcccacacaataataatgggagactttaacaccccactgtcaacattagacagatcaacgagacagaaagttaacaaggatatccaggaattgaactcagctctgcaccaagcagacctaatagacatctacagaactctccactccaaatcaacagaatatacatcctcttcagcaccacaccacacctattccaaaattgaccacatagttggaagtaaagtactcctcagcaaatgtaaaagaatagaaattataacaaactgtctctcagaccacagtgcaatcaaactagaactcaggattaagaaactcactcaaaaccgctcaactacatggaaactgagcaacctgctcctgaatgactgctgggtacataacgaaatgaaggcagaaataaaaatgttctttgaaaccaatgagaacaaagacacaacataccagaatctctgggacacattcaaagcagtgtgtaaagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagtagaaccggaagacatagagacacaaaaaacccttcaaaaaaatcaatgaatccaggagctggtgtcttgaaaagatcaacaaaattgatagatcactagcaagactaataaagaagaaaagagagaagaatcaaatagacgcaataaattttcaattgttacacagttgaatattagttacatttagtagctaaaggcttagattggagtgtcttttttcttcagagacagttttgttaaaatggtaccagttagaccaggtgcaggggctcatgcctgtacccagcagtttgggaggctgaggcgggtggatcacaaggtcaggagttcaagaccagcctgtccaagatggtgaaaccccatttctactaaaaatacaaaaaaaaatattagccggacatggtggtaggagcctgtaatcccagctactcgagaggctgaggcagagaattgattgaacccaggatttggagattgtagtgagccaagatcacgccattgcaccccagcctgggtgacagagcgagactctgtctcagaaaaaaaaaaaaaaaaaaggtagcaattataaatgtgttattggcttgcagtcattttttctatggagatatacatatgtgtattcatgtgtttgcatatataatgtattgagatcttactacaaacacatatcatattttacacatttaacattatatcatgaatgtttcttgtattacacacaaaaaactcataacaagtatttaatattcaataggtacttaatatactatagtatagatgtgccaacatgtatttatcaattccttattgttggatatttaggttttttattcttactatttgaaagaatatttattgttaacacatacttctacatttttccttaatatgtataacaacaaaggaattgctaaattaaaggttgagtatatttttgaagacacttgatatgcatggcaaaatgctttcaaaaaaattacatcatttcacatggcttctaatagtatacaaatgtgttcatctgtctgtagttatatgcatttgatagataaaaatggtaggttgctctaatttgcatttcttttattcctattgagaccaaacattttccatatgttcttttcctatttgtttgtctttctttttttgtctgctcacacactttgcccagaatattttagaggttttaaaatttgttttggtatttatggaagctaaaataatatagatagtaattcttagtcattacaattttaaatattttatctgatttatctttttggtctttttatgaggtttatgatgtagtacttcagatttttgataattaaatctttgctaatttatttttataaaaaatattttctccgtctacagttgaaacatatgttgctttattttgctaaatttatcagacttaaatttgtatacatgatgctgcctgtttctgagctatttatttcttctccttttacctgtttctaatctgattgaattgtggtgctttcaacatcttaattatttagaaaatacatttgtatcttatgggtaaagtcattattttctcccttcaggttattattcatttctgttaaaaggtcttagttcttttcatatgcatattcttccagttgaacattagattgagttgaaaaaatgacagcaatatttttaatggagtctccttcttatacattaattcttctgaaacttacatcttaaaatatttctcatctagaaatgtgttatttttccatttacttaagcagcttgtatctccattaaagttttgttattttccccataaggacctcacattttttgttagggttattccaggtatttttacttttgtgatggtgttcatttatttttattataatatttaaaaaatctctggtattacgtcagtgtttttaaaacatgccatttttattcaatactttaaaaatatttataaatctctgagttggcaatttctccagctctaggaagacagaaaatacacagatctgtacactcaaagaacgtgagtccagcccactcagtcatatgaacttagctggatataacacgttaacagacaggatagacatttttaccttgaacagaaagagctgtaattcaagttctgtgtcacagatacaatccgtacattatggtttctttaaataagccataaccaattttttttagtaattatttgcttccagttattcatgtgagattattaaaataagcttatgaagtaaatataagatgtttcaaatattcctatccattgagaaccccagaaattatccttattgaaatttttagaaaaaaattagataggtgcacaggaaaatccttataaaattatgtccctgacagagtttatatgtataataaaaatcaagagggtgggtgtttctaaatattcaactatatggattgaaggcattgtggtaaatccattacaaagattatactgtatatttgttgatgagaaaatatatattcttacagctataaaacaatgagcatcataaaattctatgattgcaatatatgacagtagatcatatatgtatagatgtatgtccatatatacgtgtgtgtgtgtgtgtgtgtgtatatatatatatatatatctgaacaaatatgaaggacacacaccaaaatataccaaaatattaataacaatgattatcttcacattttaggtaatttcagcttttctctttatggttgctgatatagccttaacatttataataaaaaaaaattcttttgtagttagacaaagaagaaatatgtgaagccaaaataggaaaacatgggggaaggaaggactttatatcatgtttcatctcatagcaaaactattggaagcatttcagaaacaaaagaccttaaaacttcaaactctaataagaaattgggaacaaaaatcttgagattgttatacaagagatgttaaagaccttaggcctcagtttctttcagaagcccagcaattgcaattattatttattatcactttacttttgcttgaatctctttagctaaaggtggtttacttccacttttccctaataatttatgtcttcatgataatagattttcttattatctttctgatttgtacctgtttcctatttaatgatttactctgtatggcatacatgccaaagttatcatgctagaaaaattattatgctataataattatgataccatcaaactgaattaaattatgtttcattgtaaatagtaaaatgtattaatttttttaaaagcttttttatgccagcggagataaataaagttacctttatgtactttcattaaacacaatgacagtacaagccaaactgataacaaatcaacgcactccttcttgtaacactcctaagttgttctgaaatcagctttcttaggactatgaattcaatgcaatgtattaaacagaatctgtgccttctgtgaataaaagtttcacctccatctcttgtgagtatatgtaggcagatctttgaacaatgaggttttcttccattgatttaaaatgaaaatgaacctggattttaaatgtgcattctaattgtccctttagcacatcagaacagcactgcctaatagaaatataatgtgagctacatatataattttgaattttctaaaatgcacattttaaaaaagtaaaatgaaacagttaaaactaatttagtagggcttggtgcggtggcttacacctgtgatcccagcattttgggaggctgagggtggcagaccacctgaagtcaggagtttgagaccagtctgggtgacatggcgaaaccctgtctctactaaaaatacaaaaattagccaggagtggtggtgcatgcctgtagtctctcagctactcaggaggctggggtgggagaatcacttgaacgtgagaggcggagtttgcagtgagccaagatcacaccactgcactccagtctgggcgacagagtgacttagtctcagttaaaaaaaaaaaaaaagtaatataccttatttaatacaatctatctaaaatatcattattttaacatgtaattaaaacctaaaagttaatgagataatacattattttttctaccaaatctatgtctgtattttacacttataggatatttcaatttagattttttatcagatatattcagtctgcatttagatgtcataagttttcagttgagaaagtagatccacataccaaattgtttcaaatgtatttaaaagttttccagtaactgaatcaatgatcaatttttaatttaaattcattaaaatcaaattagaaattcagctcctcagccatactacccacatttcaagtgctcaatagccatatgtggataggggctattgtattggacagcaaaggtttagaacacatgtataagatgttaacacagaggaaaagttaaaagttaaatcaatgccaaactattgggaatgttttgtctaccgggtttcaagaaataatgacatgactgatatttttcttattgaatcagctgctcggctggttggctcaactaatagagtcaaacagttgctgggttttataaacaaatcatctccttttttatttggtcctccaattttcttaaggcaaatatttgtgccaaattatgccaaagtctgtctctcctgaatatccctgttatcctcgaatattgttgagtgtcccatgaatataactgttaaatgctgttttgagttaaaaccaagaacacctatattgagaaaaaaattaaatgtagttaatgttgtaccaccatgttttgttctagcttctcaactgtctcatgtaaataagcacaataaacatctactgagtgattctgtaatagtttggatctataggtccatcatttgtgatgacacatagaagttggcccaggaaagctaaaagtatgtcatatgtcaaataatgccttccaccaagtttagagcagcatttcttccccagcattacaacttcatgtaatggcacttggcagtattggcatttctgatatgacttcttttggctagttcagaattcttaaaaaataaatagtttttcaccctgtgattgaaagggttaaatagtaccaattcattacactcacaaaaggatttattttgttctcataaatcagttttattccacatttttattattcccttgggtgagctactccaattgaaatcaatacaagtgcaagtgagacaatcaatctcgatatttgattatggattggagattcccaggtccgctttttagccagtttctttctgatcatctcccccaaagaactgaatatttttattgacatctatgagttctgaacatgtttagaaagaagataataatcttcatttgtatactgacaatggaagccccacaaatgaacaaggattaaaaaataaagacttaaaatatgtagctataacatcatcagcaaacttcaaatttctcaatatttttcttaagatgtagtcatgttttaaaataactttattctttcttttaaaaaaagacctgttaatacaactggtggctacaaaccacattcttagggtgctattaggtaaatgattatttttcatgacaaagatattatttattttcacatgcttgtttcagagctgaaccatatcaactggtctaggttaacaataagaaaacagttaaggtgaataaaatgcctttgaaggtatccagcctaggtcttttcatttctataattgtccaggctggaaagccaccatctgggggatttaaaagagaaaaacagctcaactttaaattagagagcaaaattgattaagttgttcctcaatgaggccaacatttatatatcaaactctctttgctttacaaacaaatttatatcttatgatcctttacatatcgaatgcttattttgggactcatggtaccatattattgttctcttgcctctgactctagccacctgttctaggttcttaagcaaaatttttgaaaaggcacaattaaacctttccgtaattcattatttgatacttagaataaggcaattatttgatgcacttatctaatcatattcttaaaataaatttcaaggtaatattaacactgcatttgttactttcagcaaacattttagccttatttagccatttactaattttcactagaatccattggaaggggatgtttcatgttttggacaaattacctaccactgattttttttcaggaagacatataactttgaatgttgtaaaaaagtattttagaaggagttaaaatagtaaacccatatttctttcatttaagcaacattaattactcttcagttactcttattaagcctttagaatagcagctgtataagccatataagccaggcacttggatttccactggcaaacttcctaggcatgtggaattaggggactgtctagaacttatttttgtccagcttcatttccttttcagtaatttgcatttattaatgctgaataatgaaagataatcaaaacattaatgaaggtatggtgcagtgatgtaacaaagggctatatcaacaaaatattctttccacgtgctttgttccactctttaaaaaaaatatttactcaagagaatcattctagaaactggaaattgctccctttattcaggaaggcagtatattttttaaaagttagcttctttaattgtttaattcagaggttggcaaatcttttctataaagggatagaaagtaaacactttagactttgcaggcaatatagtctctgccataattactcaattctgcagttatatcatgaaaattcctagaaagataattacttttgttctaataagcctttatttacaaaaataggcagctggccaaatttggcttgtagattgtagtttgtgggaccctgttttattataactcgtttatacattaaaatgcaatttacatactttccttggatatttcaatcttctcatgattcatttgattttgcaaaaattatgaatgctaatttaaaaatctatgtaatacagaaaaacaacatccactaaaatcccactacccataaataaccaatgttaacaaacagtaaacattattttagagctgtctcaattcatgggtgattcttggtagcaaacaacagaaacaaatttggttaattcaggcagagatgaattatattaaaggaattcaacagttcaaaaagttgtcaggaaagctggagagtcagacttgtggagaaccacaaataacatagcccagaccagcttatgccttcttaggacacccccactggcaccatcaccattcagtcgccttggaaaattatcactctacttctggattctcaacaattttagaggcatcttgaataatccttagttgactgtgagccattgtttcactggatcaagctttgtagtccccagatgaaagcaatgcaactgactggcagtcccatggtcttaccacatgaacttcaggtgtcctttcatttacaaaaaaagagaaaattaagttatgtttctaatcatttctttctacatacctattatcttctccctgattgttagagtttcttgatctttttacttatgcattaattatgattctctcaaggcttttcatcataccattgatttagattttagctctattctgttcctggctttttctaacttgtttattaaatacttactgcattttttaatttccagattgtttctctgtctctgcaatatcattttatcatattatagggaatatatatcattttttcccaaactacatggttattttgtctttttatgttacaatcctttctttagctgtatgtataatactcgatatattatttttttcttcaacttcatcttgcttatgccttgtatgggcagctctgtccagattttgcactggttctgagcttggtctacttcctttcctttctggtgctagtcagtcttctttcgacctaaattttgagcactaggtgttgctagagggtgcgaagatgcactgggcagaattctggggaatccagattttctgtctcctctgagatcctattatatagcttttgtggcagcacttgctgcatttattcacatgtatctcccacacctgggaacaccagctttttcccccaactcagcacagtgcttggcaggatggccagccctgatttctcttcctgtctctgcagactctactcagttcatttctctacatattggagaggattttttttggcttatactccttcctctgggaacaaagttaggagctgcgctatactaagaaggaatttaccatctctttcttcttttaggtttcaaaattcatgtcggtcatttttttccttttcctttatacatttgtacctggagaatcttcaactaaaattgttaatgttactgttttcatagtttgtttccattctgtcaggtattttggaaagacagttgtgtggtaccacttaatttagaagctgtgaaagttcacaatttgtccaaaatctctttctagcaaggtgattcatatatacagttcagagactaacagggagactgtaaggtggcatctgactttccccacctcctggtgttcatgtccttgtttactctccttcccttgggtgtcttcaaaacctgtgacttgctgctcaccagtagaacagaacaaaggtgatagcatgccacctccataagattgtaacctgtcttgctagaagactccctctttttgatacagcaagtggtcacactggggaggcccatatgggaagaaatgagggtgaacgccaggcaacacaaaactggtaactgagagcagccttgagtcaatagccagaaaaaattgagaccctcagtctcgacagcctacaacaaattgaaaactatcaacaaccacctgagcttgcgagagatccttcctcattggaaccttcagatgggatttcagtcctggccaacaccttgactgcagtcttttgagaccctgagcacaggacccagttagctgtgccagactcctgactcacagaaactatgagattctaaatgtatgttgctaagttcgtggtgataccatgacacatcgataggtaactaacacaggaacaccttactgtgtgactgtagcaaatgaaacaggtagaattcaacagcaaaacatgatatcattctcatccagacccccaagtcgttgctcttcttttacagaggaaccatctcaagtatatatcttccagtaattagaagaaaatgttaaacatgtcattaaacaaagaatggaccataggctttgtctgggatcaataatggttgtcaaattacttgtctgatcctagtagcaccacaggctcagcaggttcagcatggttagtaaggctctaccagaactttaaaaggaaacacgttttggtgataaaatagttgtattcatgtccagtgtttagtgtggaagccggagaccactttctatgagagtatatttgttcaataacttttagctgattgagataacagcatcagtttgttcagctggaaaaaagtttgcccaaatggcaaaaaaaataagtcaaagtggaaaaaaaccctgacatttcagagcatatatggttagtaaaaatagaccatacttctacaatttacaatagtcacagtacatctctgaatttactctctctctctttctgtgtgtttatatacatatatatagtgaactgtactgaattttatatatcgtagtgaactttatatataaaatgtataatatacatgcatatatacatatatctttcatttttataactatttttagagcagttttaggattacagcaatattaagcataaggtacagagatttttgtctatcctttatgcattatagttcctttctgatattcataaaatgagatacatttaggaaaatctgactgtggtacatagagagagcttgatggggaaaaataaaacatgcttcaacaaactttaaaaaataatttgcgatatttagaacagtaattgtgcctacacgttaaaaaagatctagagaacaaaacataaagattctcgatatctatagagttgtcattgctcttgtatgggcacaaccaggacaaatgtgtctgaagcatcttttggtgagttgataaaatagtgcatgtatttattccctgcactacaattgtcaggctagaggaatgaccaatttaaagaggagtcaaagaagtacagctttgactagatgacaactaattaaaatcactattacagtaattacagtaatgtaagaaatatgatgcattaatcgagcaccgtcctcagaaggtcttagtggttcataggctatttatttctctttcaaaatatcctgtggagaagacagcttcgtaggcatatgtccataaatattttatacattgtcaaaaacttaaggccaggaatagatttctttcaccatatattaattacaaaataaacaaatactcagcacctttcagattcctaccaacatgagatctatcagaaaaatggaatctggaagaaacacttgctttttggttaaaataatttaaaataatatttttagaaggaataaataaatgtaacttaaatattaatacagggtatatagagagacctgaaattcttggctcacagtaaaggctgattttgccagtttaccttgatcacaattcagtgtcttctgattttggtattggcagaatttcgtgatagtgagatggaactgaacaactctaaaattgagaccttaataccagaaaaatatagtatttctttgtacagcaagaagtgggaaaaattagttaataccttttctaccttaaggtgtaattggattcagaaaaagactaacttaaagcaggaccaggcctgacatataaaatcctcacgaggtaacaagaatcagtttggtttgttcactgtcatttctcattataatctttgtcatgagaatggattcatgttgtgccattttctgttcctgttacaatctttgtcacatgaataagatatcaggatgttaatgcctggcatacagtattgtgtgtgttatgatactgtacaggactacgctgacctttgcaatattatgtattctgattggttgttcatgtcacctctttcccacaagttaataaggctgtaaaaaggagagaactgaaatggccagccagtcaaattatagaatattgaaaaggtcagagcagtccagcacagagaaaaaaaaattatggaatatatggtgcattaaaattcttgtgacaatgattgtaacaagaataggaaaggatacccatttatgttattccaatctagagaaccccataggatggtattctcgagacagcaatcatttacgcatccctgagtcatacatgtgaaaatatccatttatgctgttttttccttaaaaataattgcatagattttctactattcaacaaaaaagagcattgaaaataagattttcatctcagaaaaggggcattaatattgttaacatttcagttaagactttatatttgagactaaagaaaaggtttttttataagtaaaacctgttgttcatatgagatttatttggtctattttttcatgtaacacttttctttgaaataaaataggagagtaggactgaatgaattaacctttttcaagaccctttagaatgtgggatagaccgaaagagcagttaggagtttatgtagaaattctacatgatctatgcaaaacttattttatctttatgatgtgtgatgttggccaatacacaaaaaatcttttcttcctctgcatcttcagtggaaagatagtgacagagagaaagaggtataatacttaaatcagaaaccctgatgttattgttcttaagtgtgcaataattacttatttttcaaattgtttttatgcatattttaaattttcttgtagaacaacttcattggattttgtagcctataaggagacatctgttttaaaccttagctttacacttatttcactaatagagtaaacatgttatagtccaaagctagtcaaagctagtgatcccagcaccctatgctctgatgctcatccagtaggcctggcgtagaattcagatatatgaatgtttatgaggtaaccccaagtgattttgatgtaggttgtgcctggaatattggtattggcaacctcattttgcaaagagctaagtgagacccccagttaaagcccaatggctcagaccaagccacagagggtggaggagggcaactcaacttcaaatcacagtgcttgggtgggggcgaagcaggcagtggggagttgcggttccagaactcagaagcttaaaaggtcttgcaccatccacttatactcacaaatagggtcagattggagggccaaccagacaggaatggtcgcctgcgataggacacacttatcactttcacattttcaagcttgatttttgaggctgaaccaacgaggctgcattttccagcccactgaaagcccagtttatgcagtgaaaagtggcaaagcacaaccatctcaacaagaggaacctgagcacaagcattttaaaaatctacccctccccgcccatattgaggagcccaaattcctaaagttcaaaggaagaaaggaaagacagtgagagtgaaatggaggaagagctaaaatctgtggatcctgctttggttttgaatctggaaatttttgagcttcattgagggctgaaatcctgtcagttactctaggtctgtgaattgaactgtatgtttgtaggggtgagagaacattagactcactcagctgtatagttactggagatgtacaagttcttttttgagctgagcaaaatggttatgtaattgcatacttctcataattattgagtaattatatacttcttataattactgagtaatcattgttctataactagaacttaatgttacaactaattatataattaccatgtattaatgttgttatctaggaagcttagaatgaagtgctacttatatatctccccctgccatgccattttcaaagcaagcagtagtgtttgttttttgtttgttttacagttcaaaatttccttaaaaaacaaacaaacaagcaaaatgcaatggaaaaaacttcaccaatattatactcatacatatttactcattgattttgtatttgtccctggctgaaaatttgtaaaattatattctcatggcttaattttagaatttccattgttgctttacaaatttcaatcttttataagacctgcacagttacgctacttgagagtcaattgaatatctgcttgagtctataggacaagctgacctttttgaaagtttacaattgagcatgtaatgacagcagaaatacttccaaggagctcaatatcatggggacaggaggagatctccccatgctgaccatgtaattgttcttaggcaatggttaggatggtcatatttaatcttaaccaggtttcttgagtgcaagaattatgtcttatgtacttggggcatgttctcgtcagtgcctagaaaagccttctccttgcatgcagttggagctcaataatcttcagtagaagcaagctgactagttgtaaagaacctaggaaagctaaaatggcataaattggaaatgtctttttagtgcataatgaaattatcaaaggctgctttgtaggtttcataatgtcttgctaataagtattacacatatagaggagtgcattatctacttacattttaggaccttgaaatcattctttaagctatgaatatgtctttatctgcctttactgaaagtgaatagaaattatcattgtcacgttttagcccacaagcactgtttatttcctttgaagtaaactacttatttggatgtgccaattttgggtccagagtaataaattatattatgccattagggctttcttctgctcatgaaaaaaactcctgagtattttgtaacagtagatttttcagtgacttcctccatccctaaatggttataagtatctttttaaataactttttgtatgtttttacaatttgttggacctacccatatttcatgaaaatagtcaagtaataaccagatatcagaccctcttttgcattatttgatcttcattaatttcagtttgaaatataatctgatgggacaatgacacattggtaatggatgagattagtgctgctttattcattgaaaaaccttagaattttgatgaataatacattgttaggttggaaggggtagagaataggtaggtaattgctactgagaaaatgaaatacagagtacaaaattcttaatcacttgctagttctgaatggctagaatgtatcagttgtatggattacaacaaaaacaataacatcattcctagctgttgtttatgagcaactattatgtgctggatatgataaagaaataatctcacttaattttcacaatagcactgcaatgtaaatactgtattatcattcccagttcacagatgaagaaccagacattcagaaatattaagtaaattagcaaagagcacattgctaaagaatacaagaacaagttcaaatgcaggacttttgacaaccaaatttatgttctttcctttgcactatactttgctactaaactgtgttaaaatataatgtttttgtaaatattgtaaaccttgcattttgtatactatacgatgcaagatcacttttagtatgatgccatcttttactttttaagcatttgttcaataaagattatatcagtatctggagatcttgccagtatgcttgttcttctctttgaagctcaatatcatgtgttttttaattcatttgtctatatctgcagaatttgtgtgtgaaagattgaatgtacatataataaaaagtggttttatataggaaaaaggttatttgaagtaaatattggtgctcttttagataaaaaaatctcactctgtgacccaagctggagtgcagtgacacaattatagttcactgtaatctcaaatttgtgggttcaagtgattctcccacctcagcctcctgagtagctagaactacaggctcataccaccatgaccagataatttttaattttaattttttgtttttagagatgaggacttgctatgttgcctagcctgggtggtactcttaatcattcatttttctgttttttaagagttattgtatcatttctaaaagtgacaaacattaagcagcatttaaaaaattgtctcataaatttttcaggaaagcatctaatatagaaaatgttacaattttcatctgtagcccttttcttattttaaccctaattttttactcttaacctgaaatttaacctaatggtgtaagagagagagataaaacactgttactaggcagaagtattttcctgcattttggactgatgagatttaagaatgggtttgctaaagctttggaaggacagtggtgttgggaccagggtgaggatgtattaaaagtgattcttttatatagctaggcagcttctgcattttctcataaagctaaaaatattagatcttctgatcaaagtggacatatagtacctcccatccccagttgcttttcaagatattctgactaattgaaatttaaaagggcattagatagaaagaaatccacccacatttcaagcaaagtgaacagaaaacacctcagtttgtgaaatatacaatatctgacaaatatgtctgagtataatacgtatatccagaacaattctatttgaggaataatgtgttatttcttcctgtctgcacatccaaaaaaattcagggatttttattggaaaaaaaaccctcaaaaaagtataaacaactcatcaagtaatcaatttctacatttgtgcaatacttttacttatatgcttgatacttgtgatatggctttatcctacagttatctaagaatattcatcaaattatttcgattgccgtgatgaatgaattggccaggtcaactcagatagcacttttgttcacaagataataaaatccaaatatgtgcattgatagaagcacatgtaatgcctcttagagtggtaaagttacagacctatttggtacagtatatttagaaactcaagaaaatactcaaataatagcaggaatgaattcttaaatatgtatttattttaataattttcttttttaatcagtaggtaataactacacccttctgaatgtcacaaaagtcatgtacagcggagaagagacaaacctttgggtgctcatcgatgggctggttccttttaccaactatactgtacaagtgaatatttcaaatagccaaggcagcttgataactgatcctataacaattgcaatgcctccaggaggtaagtctatgcaaatgttggctatctaattttatataaatgccctagaattaagtttccattgaataccttgtttatttttagaggtattttattttagaacttagaggctcaattgtatttctggttcttttaatagttgttgttttgctttgtttattcagattctttaattgacgatcttttattgttttgttgagactgctttcatccacctcacactgtgtgtatgtgtgtgtatataccatacacacatacacacacacacatatatatatctggatttctgcatgttaagaaaattgggaaatgattttgttcaaggcgttacttaaagccaaaatttatatttgcaatttgagcttccattttctactgcaaatggttctcattcctggtgttctaaataactagttcaattgtatacttaaagtacttcatttggcaaaaagggcagggtgcagatgatagaataggaaaattccatttgcactactggaaaacacctttaaattcctgatcctaataattacagttcagcagggccacattcatgtgtgaaatgtgatacagtctgcatatttttattttaaatatttctataaaaatcgacctattcacaattaccattattttgatgtgccttcagcttcaccatgttttaactcgttgcgggaaataatcgcattgaggaaaacccctctagggttgacatggatggcccttgaacagaaagcatgcctcaaaatgttaagagcatgactctcaattgagtgctaaagaatgtgtgttttctgaaaatcctgaaggcaaaggaccccaggacatccagcatctgccctgtagcccatctcccaggaatgagtatattctgaactaagggagaatgtcacaatcttttatcagcaatccgaagggcaggttaaccccacttccagttatgaagagtataagaacacaaagtgctttatcactggagaaaaataaaagggaatcttcagtttgtatggaaccgctcccctgcaaaaaagattcattacttgttgtatcataaaaccacacactattatctaccttttatgccattattaaaattaatgaattgatgtttactaaaatacttgaaactgtaaatgtcagaagctacattacttaagaaaagaatgcataaaagaaacttttgaggctgatcaactcaggttagtatcatatttattgagacaataattttaaaagggaattgaatttagatatatttatttaaaaattgagactgaaacccaaaataaaacaaactccccccgctaaaataaaccttaggtattcatatcttcatttttcacttcaatacacatgctaggaaggatagaaaactgtgatggctctaaaccttagaatataatatcctttactcaaatttagaaattaaagagtaatcagtgccataatggaggttttaagttatatagtaataccttttctacaggatatatacaatatttaataagcgtgtttattttagggtatttatactgattaaatagtttgtgatttacagtaatttatatcatattcataaaatagggcaaatttaattcattgtttatgtttttaggaatgtatggtctaataatttgttatttatacatatatcaagattcaattaaaaatagcaaggtcctactgctaacggaatatgcgctatgtgaatatacctgtcagtaaaagggttaatattatacaaatagaaagaaactaaaatattgttttatagtggtgcagtcaaactgagtaaaccattaactgaggcttatcttcatctttgctctgtggatgcttatctgtgtcattaccataatgcactgcaggcccacactctctgggcctgatgcaatcctccactttatgtattcagaaatctagaatttgggagtcagtccttcaccaaagaggaagcaaatgtcttcaaagacagacagtgattcgctaaagtttattatggccattaggacatactttcttttttcattagattgttgttgattacaattaggaaacgtatagctttaaaattatcttttttatgaccttgtggcagtttaaaggtgatacctcattgattaaataggttttagttcatgcttccttttacttaatgatctgaaaacatattatcctgatttacacataaaaatcatgctgaaaagcatgtggcattcactagaatatgtgtgtttaagtagaattaaattagtactgagagttattaaagaaatcttccatgcctttgtccagtgaactgtgtttcattctgaaatgaataataaatggaccaatatacggaggcaaaccaacttatgggcagagaaggttctatatgctatttacttttccattatagttggattgttatcattattgccatttccttgatttcaatattagatctctcttatggtgatgttgaattcctagtatctttcaatgctgggtgatgcaagatttgtgatgataatatccttagctatgcttcttttgcatacttttaaaacataataagaaaagagttgggcaaaataaaatgctcttttttacttcatcaaatatttgctatcaaatatgacctggaaaatcccctttacccgtttaatctggccaaatcctactcattttttagcctcaaacctagaaattggtctatcagaaagtcatgttttgccaacagaggctgagatagggcctttctgtatcccagagaacagttacattatactgaaattgcctgtttaatctgtcacaatcactggttataagatcctatagagtaggaactgtttcttactcacatttctatcttcagcacctagactaaacctgacacatggtaggtgcataatgaataattggtgaatgaataaattagtcaagattgcttaacgacttgttttaaattttaagcttattattactcaggccctccaggcctcatctcaacctcagcaaccttgtattttagccagctgtgaaagagaccttctctgtacaccactgtccaatgtaggaatgctctggttatgtagataaaattgggagctcaaactgtaaggagggtgagtgtattggaggtgagaaatattctcaagttatgccaactcttcattcttttattcttccctatagtggttacttttctcaggtgagcatagaataaacaatccttagtttagatagtaatttggaaaggagaggtgaaagggtcatactccaaagaattttaccaggatacatcatctcttaatttgtagtcaggacacatcttatttgccagtcctacctctatttttctgatgagaaaaaatatataattaagaatatgataaacacaagttatttgaagatagaaattaaagtaagaagatggtgctactaataacttggcacatagatgaacagtggcaaatcccaattaacacacattttttatttgaaaaattcactttaaatattatttggacaactggaggggcgtctctgttttttccaattatgtagcagatccttccctacttctgcacactcaagttttttgtatttctacaattactatatttttaggttgtttgtaataacataatgctcatatttagcactaaggtattcttggaaataaaggatatatttaatcagagctcttgaatagtattatggtacaggttcaagagttctaggaaaagaattaaaaaaataaaaacgaatccaaatgttaatccataaatatgaaactttcctatggcctttaccccttcaaggtctggagttactaatggggttaggatttcaacgcttaatggggctcagtgcattagtgttttgtatgcatggaattcagcattcagtttaataagtggttgacattggtgatgtcccttaatttgcttaaatctaattggctcttttatcagtcaaacctgtatggattggcaattgatcagaaagggtcagccatgactctgcatgtagttaaatgatggaagcaccagttaaagtcacagttgcatgataataagcaaaagaagaacaaatgagcttagaggaggaaggcaaagaagcttagaagttttgcaggatcttcaagttcagaacaaaggcattatagagtatataaattttaaatacactgcattttgcctccagacttaaacctttttttttccagatgaactgaaatcttgtctgaaactgtctttgttacatcaaagaactactcagaaagctaaaagagacagaagaagcataaaagggcatagtttaaaatgattagtgacaaattccatactgacgagctagaaacagatttttaatgaaagttttatattattccaaaaggaataattctgtttatctttttctgaactgctttattgtaacagtgaaaggaacttggagccaccctggtttgtgaacctaatccaattttcctctgagagtaaataatttgtcatttgtacttttaagttgatgagaattattataatctacaaacagtgtaaaatactaggcttgagaaaatctgtttatttgcccaaatgtgttattagagaaccaaaaattgaaaaaggcaaaatggttgcgagtagtttgttttacagggtcttttcgactctctctccttcccctgaaccccctctccacttatccacctaaaatatcaatgagaaaaaaaagaaagaaagaaaaccattaggaagtaaaacttaggcacatcgcaaaagcatagacgttggagtcctagaaacaaggatttaaatccacctctttcactcactgcttgagtgactatgagcaaatctgcagatataactgagcttcagtttgctcatccattaaagaggctggatggtaattcccacctgactggaggattgaacaacatattatatgtaatgtgtttagcgcattgcctgtcttggtaaacatttggtgcttcctacctcttttgttctattttcctactaagactctttttggggacctggaaaatgccctatagaaaaagtaagtaaaaaaacctgtctttcacatagactgcagagaccagaataatttcatcttgctacatccctatcctttcctacacttaccccttaacatgttgacatacatatggccaggccagtaaccctgctaaggggtggttgtgatgcatattagatgatgaagtaagcaggaagcatgggaagtgattttctttttgaaataccttcagcatcctcctccatgacctccagatcataatttgcgaagatttttacatcaagctctcattggtcatcttgggatttcacatattttcttaatagaactcttcttctgtgtttatatagagctacttattaaatataattatgactttttaaaaaatgtctattattgtatattttattcacaaatgcttttttttacattgttaatgctagcccaaagcaagtaatttgaaattttatcctaagatgttttcatgttttcttaattgtcctcaaatacatatatttaaaagttacatcttggaattcaaactttttttcatttttcactaaataggaaagtttactagttgttcagccaatatgcttttgaataactaaataaaatgtttgcttttaaaagatgttagtatatgatttttgcccaataataccactaaaggaataatatattaatgactaacttttttagcttgaactactgaattccattctgtttagaatttaagagactggaatattctttcgggtattgctgtgtaacgagtcactccaaaagtcagcaacttaaaacaaccattctgtattatttctcacctgattgtgtgagttgtcagcatggttctcctggcttaaggaggctggactgggcttcttcagaattcccagaaagaaactcagggtttcaagagtcaagccctagtgtacaagccctgaaaacctttgcttgcctcaaactgtccaaagcaaatttcttgcccaagtcaaaaagcatgtatgctggaatgtatgatttactggagcctgataatttgtcaatcttccataaatgtctaagtgattggtttttagattgtgtatgtgtatatgtacaaacacatacatgcaagtattacagatacataatttttcttttaaattagttctgcttttgaaataatgatgtactagcaccaaaaaaaatgaagaaagcagtttactaaatttttccttgaagaagatataaaaaaaaatctttccttacatgacaattaattttgatgttttatttcagtataaagatcaataaatgtatatcaatagattcttgtttaaaatgtttgtagctccctattggagggaaaattctgatctcttcttataagtaggtgatttaaaaaaaaatcttagctatttctcaaatctaggccttgggtattctgatttctgcttgtaactttgaactgtgagagtagaaactgtgtgtaatttgaatattttctgtagctccagtgtctggcataaactatttgctgaataaattaccagagccctttgtggcagtgataacttggaaaataatcctgaaagttatattttgctattgctgtgtcttttacttggataaacattttccagaattaaattcaacatttagggtttaattcatcctaaaattatttttagtcctgttaagattaccataacagtgtaaaaatacataatataggaccctctggaggtatgtttataaatttgtgtgtgtgtttaattgtctattttacctaccattttattttttatttttaaataattccatcttttatattatgtttaggggtacatgtgcaggcttgtcacatggatatattgtatgatgctaaggtttcaggtatgattgatcctattgcccaggtagtgagcagagcacctaatagttttcagttctttgctttctcccactgttccccttctagtagtttccactgtaaccaccattttcaattaacttatctattgtgattggtggttgaacacttaactgaaaataatgattaaaacagaacatccaaaaatttaaatatatattaaacacaactttaatttagaacacataaatatatttatctatatatttatccaacaatcttgttatatagggccaagttgttttcttggagtgttaatttagtatttataagtccagcatatttgctgccaaaactatattcataatgcatagtttgatttccactttgaaaactcctttaaaaggagaacaaaaatttagagataattaaggaagaatctaattatagaatttttcaggcttttgtaatatcctaagtcttttagttatttttcctgaacgaatttcacagtattgttttattaagtcctcactgaaagtttttcaaagcagtaaattttcatagaaaacggtttctgttaacagtgctcatcagtttaagcattatttaattaaatgacataatcataatgacaaccacaattgacatcacaggtttaaaaaatacagctgactctttgtgagtgtataattctacctgcgactgcagaatgttgcccttgaactacagagtagtcaactatccatctctgcaatacagagtaaatgtaaattttttattaatctggcaagtcagataagaataggtaggtaaggctgggcgcggtggctcacgcctgtaatcccagcacttcggaaggccaaggagggtggatcacctgaggttgggagttcgagaccagcctgaccaacatagagaaaccccatcgctaccaaaaatacaaaaacttagccgggcatgttgtaattccagctattcgggaggctggggtaggagaatcgcttgaacccgaaaggcggaggttacagagagccaagattgtaccattgcactccagcctgggcaacaagagcaaaactctgtctcaaaaaaaaaaaaaaaaaaaagataggtaggtaaagcaagtgtctactatttaggaaaaagacacgcttccaaagtggcagaatgatccaccctcagagcagcctacccaagtaggagaggcaggacaatgctaccaaattcttctcttaggttaagcattaccacagctctgccttaaaagaaaaaagaaattattgattatatcccttcaattgattagggactgagtctgagatttgtggcataacttgctcagtgaacttatttttctccttcagtttttaaaggaaagaactgagctttctcttctattttcaaatttcaaccaaaatctctttctaagaccttagagcaatgaaatgtgtgggtagcactatcaaccagccaggtggagaatggtatttttttttttttttttttttttgcagggtctctaagagaattaggggcaactagaactggctcaaaaagcaagaatatacgaaagagcaaaagagtaaataaataagaattgcaaaaacaaactctattgtatcttgcactttcttcatgcattgtagcactgagaattgtaaaatatttctataccttttgtttgtttttgttcttgtttttttgagacggagtctcgctctgtcacccaggctggagtgcagtggcgcaatctcagctcactctatgccttttaaaatcaacttagtacaatgtcaagatgctactttttaaaaataaaactaatggttctcaaaaatgtgaaagcttgcttgccgagtacagatataaagctcctcaatatgtgttttccatttttcatctgctctgtatccacttagatttatttgaaatatataaatagaaacattaatgtgcaggtggcaatgggatatcttaaaaattgaaagagtacaaagggatggagattttaaaaataaacgtaggttagcagctgaaataagcaataggctaagatggtatattcccttattcagagggtagaaggaaagatgagattaactgctttttataatgtaaaagccacaatgaagatacaggatggtgaggaatagcattctttaaaacgacaacattctaccacataaacagatggtttgtctttaccttcagtatattaaaagctacacaatttatattacatccagttcatatgaatctttcgaatagttgtgcataatgttttacttctgtgtatatcttccaaatgtgctgctattttttccctggaaaaatcaacccattgaaagtaataaagtaggagaattcaacaaataaaaagtatttaaattcttaataaaataaatagtgtgctttcaaaaacacataccaggccatttaatttaacccatgctttctcccaggtacgagaatagaaccaaaggatttatgactgtcttaaacatgctctcaaatcctttcctgaaaagtgttacctttacttttttggaattgatagtttaacctgctttgtgtgtgtgtgtgcatgtatgaagaggtatatgtttgtaatattacatatcataagccaaagagagggataaattcctgtttcataatttgtgaacaattttttcactttttgtattcaccatcttgacaatgaacttcctgcttataaaaacaccttagaaaaagactaacttctgagctatggagaagagggaaggaaactttgaagtgtgcttactatggactcaacaagcctccagcaaagggctgccagctctccatatttgcatactctcatgtggattatatagaaatacacacgcccacacacacaattaagtgctatctttaaagcatcctggggcaagagagagagacttaaaaaaataaaataaaatcacatctttttcttttttaccaggggagaggggtgggaaatattgttcctttaagttccattgatattttctaactcacatttttaaaaagaataagtacaattcattttctttttttttcttcgaagacggctttatccataactttaagcttaaaaaaaaaaatcatgtctgtctgactgacactgcagtctaaaagcaacttgaagttttatttgaatttttatagtgccctaaagaaatttttgctttatttctttaaaataatatcttgttcctcattttttcatagacaaactgtatgcctgacttgcataaaattctatgaacatttacctgcctatataaatactcacaaaagtgagaaaattcttaatatgtcttagatacttagagaccatatttccaacctcttttcatcagcagcatcaagaaaatccctttttctatctctataaaggcatatagaccccccagagtctaaaagaaaacttaaaaacttaaggaagaatagattttgacaacagtagggaaattcacttacaaccactatgcttttcatgattgttaattaattgggacaaatgaaactagaaacatgagggtatctaatatatactttattagattaatccctcttacactttgatgaccattttcaaatgtatactatctttcatttttatttaaatgtttcgtatgcttgtatcatgtcttatctactagatggggaagataaaacgaatgggctgggtgtggtgtctcacacttgtaatcccagcactttgggaggctgaagtgggaggattgttgagctcaggagtttgagaccagtctgggcaacatagtgagaccccatctctatttaaattttaaaaagaagaagtaaaatgaaaaaaaaaatgagtgggtgaatggaggtagacagaggagtcacagctggtctccctttttctttctctatccctctcaccatttaccttggctcaggcatataataggatattagtaatgattactatcatgctcttgtgcagtcctagtggcctggggctatttttgcacccagcataccttcaccctttcttttgatgacagggctccaatttccctctcagcaccctgggctctttcaagatcagaacatgcacatgcgctgtgtgtgaagttgactgcatcaccaggtctgaccaatgaggacactgtattctcctaaccacagtgattttttttcaggaatgacaggcattccaatcaaagccactgaattgcagtaaaccagtacagtaaacagaggcatgtctcttgccctgtatttgaatatgggattcggctcaatttgctgccagccatgttgcccctcaaagagtctgagaaatttagtcagcaaggaagaaagcagagtgggtatgagagaaggaggtagactagattctggtgacgtcatttgatcctttgaatccagcattgccaaaacccagctctttcccttgagtgtttttttgtttgtttgtttgtttgttgattacaggaacccactacccatctcattgcttaagcctctatgtgttgtgttttctgccacttgaaaacaaaagcatttgccacaatgcttgagagaaaggaaaacaagtagagagcatttagagaagtctcatcacttcctgaaaatcatgccaaatgctaaacttaacatatgtgtttggcttttgcttgggctctcaaattaggaaacctcaagaagtaagctggatgtcacatgagataatattttctaaaactgtgaaatggctcatcccattctgaagggtctcctcagagccacttcatttgacaatcttctgagctgtttctccactattttcaggtctcagagccctgagttctagtaataactcttgtgctaattagctgtttggtctgacttaagtaactttacctgactatgatgttggtctcttatctctaaaatggcagatgtgaattagatcagcagtatctatagtgtgatcccagaccaggaacttcaacattccttgaaatttgcttgaaatgcaacttctcaaaccctactctcaacctacttaaccagaaattctgagggtggggccaagcaatctgtgttttaatgagattccattaccaactcccaggtcactgggtgccttcacaagtttgaagaccactgagctagaccatctttaaaatactttcaaagaaaaaatatatgatcttgtctatgactttattccatattcatatttgagacaaatactcagggaaaaataggtataataggcctccatgctcaactggtctttgaatatataagtcacattcgtagggccagaggtctttccaatgtaagaaagccatcgtgttgctcacagtcttcctgaatgggccaggaacagataccaaagataaccaattccagatgttgagttctacctgtggcaccagaaagcaacaggcatgatgttttatgcactggggaacactaatcagccctactgtgaagacactgtcagctaaatttcctttgctcttcaacttcttcacagaacatctgctataagaaactccttgtaactaaaacctgagtctttcccctctggggaattttctttaatgagcctcttgtggctacatctgtacagttttgaaatatgtttcctcaagtcagttacatcttcatcctggattctagggtttgctgtctattggacctcatagctaagatttttccttctaggagttcacaaacacaactccagagtaggttgacatagtgcccagtatctagagaaaaattaagatcatgtaaccttttatttgctaaaaagagatttttgatgttgtgatcactcataccaagatagcatttattaatactaggtgcaggtgtggttttgcatatattaactcattttattctcctcacaaaccctgtaaggcaagtgctattattatccctatttacacataaggaagttgaagaaacaatattggcttgcaactagtaaaggtcatcttactagtaaaaggcagacactgtatttaaacctagagactgactatagaagcctagttctgagccactatactctattgttctactgactgtagaactatactctatttcttctactgactgttcatatgctctcttggcagcagcaacacagattttgatgccccactaatcaatgcagatctgaagaggtgacttgactctatagtagggtcaaatataattttaagggtattgttggttgaactagtaggtttttaaatcctgttgcagatggcctagagaactgtcctcagtgactgtataacccatgctctaaagtttataatgtcataagagaaaaaaaatgtaggtaaaacatgtttacagccttacaaaaaagcattaagcagaagcaatattatgtggtacgtaccctgtgtggagaaggcaaagaaaccaaccagttggactcatcctttgccagtgtggatataagtacttaacttgcccaccaagtattttgcccaacttctgtcatatttacctatgaacttctattataaattattataaattgtgatcttctgattgtacatagtttgcattcttgtgaagagacttaatttatctaatagtgttaattttgaaaaattaacaaactttcttaaaagagagcaagaaaacttatatttgtaaaaactaatgaaagaaagaatctttttcttcctgtactaaaacaattttctgtgaacagttgaaaaaacactctagtcaggtgaagacacttattcatatgtggaatattctagaaataagccatgtgaacagtatgagtatgtgggaaaattgttcactggaatggccacaaaatgaccatgcgtgacctctgggccataagaaagcaggaatactttcctcatcaaaatctgaagttgagggcatgatcacaggaaaaagcttaaatcttattcccatggttgatgctataaatcaagtaagcgtgtatcttagactgtgcatttgtaaagcacagtgtctatcaaaatatcacaattcaacttatccaccacttgctatccccagcattttcatttcctgattgtgtgaccttgagaaacttttctcctctctaagcctcattttgctcatctgggaaggggtttcataattacagaactttcctcaatgggtttagacaaggaataaagaatgtgtgtgcactgagattagctggcacattaggtagctgctcaattctttgtttaaaggacataaagcatgatatataaatacaaaatatatgtaagcttatcactattcagttgaaaattaacctgtaaacatctacatttttatcttctttgatgattccaacagctgtctctaaaactaagtgtaaggaaacagcagactggttgtggcatattaaattataagtgaggactaatttgaggatcaaagatgctctttgggagatatcgcctgactagtaggaaaagcattagctgtctccctctgtctcatgtatttgttctctctgtcttggaaatatccttccccacagtttctgaatcttgatgtttaattgaacacaaaggtctttgagaaacacaacagggggttgttcctggtagttctagcattgaggaaattgaaatgtacattttttttctcatttatcaaagaagggcaagaatctaaactgacattttatatcaaatgaattatgaactgtgtactttgtacctaagggaacaacaactaaattagagttttagttaagagagagagagagacaaaaataggctttgaataaaacatacagtaatttctgctactgtgcctgacagtgacatggccagatacagttctattgtagaactagtgactggatgcaggctactctgaaatctttaaatgtatttgagagaccgtctcagaaaaaattaaacctaaatttcttatgttgttagactttatggtcagtgaaatagtcttgataatctaaagttaactttcagctttttatcaatgcttactttcttaaaaaaaataatagttgcaaagttttacttcttgagaaagtatgaaattataggttgcttgagagggaaaatacaatgcagaataaaaataatatatatgaaaatgccacattccatctctcctctgattatctgtaacacctacacaaatactacacactacactcatatgttattgtgctcataaagagtgtgaatcctaagatcagtgggacttggttcaaatcttaatttcccccctcctactagctgtaagagcttcggcaagttatacaatcagagtctgctttactttgttcttctgtaaatggtagtaaataataagcactatctcacaggattgacactgagaacttaattatgatgatgcctgcaatagatacaacgtgatgcagtacacatagtagttgttacgttgcacagttgtttccttccctatgtgagaagattaggcagcagcaaattagaactccattatttaatggctgctgattcctgaagtataggaagtattagaattaaaattttaaggagaaggaccctataatgtctgtgcaatatatctaataatcattttttaaataaccaattgaaaattcttgggaattgggggtgattcatgctttcttcttctggacaaagctatgtattgattaccatatttttcttcacaaataagtattccaatttatgcaatataaaaataaaagaagcgttattaatatgaatacatttgttttagacttctaaatccccctaggttcataaacctaaaagtgacaaaattccttgatattaatcccatatgctttctgatgccaatgctatactggataataattttgtgactaaattactagaaacaaataactatcactgatagcctgattacaaattttcttcatataattattgatcattgctgtggtaaaatgaatatcataatttttattctcaaatgttgattctaactctactacttataaggtgaaatcagttcttagaagtctttcagcagtttaaattctgccaatgactattgttttattcttactaatagataatgtgaaattaatggcatgttgaggtaagggatgctgtcttgtccgtttaggcggctacaacaaaatactatagactaggtgccttacaagcaacagaaaagtatttcacacagttctggaggctgggaagtccaggatcaaggtgctgacagattcagtgtctagtgaaggctcttcttcatagacagtcattttctttactctaacttcacatggcagaaggggtgagaagtctcccttgggtctctattacaagggcactaaccgcattcatgagggctacaatatcataacctgatcacctcccaaggctccatctcctaatattatctccttggcggtgagaatttcaacgtaagaattataggagggacatagaccatagcagacaccccacatttaagtattttaatgctagatctagttagtatttgagtaatttaattaataaacttgaatattatatccaatcccgttgttacaatgacttttataaccaatctgctctgattcttcaatcattaaatgactaaatttttctccactattcaaagatcacttaatttcttggtatttgattgtatcttagaatagtggattcaatggcaccatagaggaagagtccaactctaaaatataatggtttattttctacacgacctcagtcattttttgttttgtttttgagaaaggctctcactttgacaccctggctagagtgtagtggcacagtcacagctcactgcagcctcaatctcctgggctcaagcaattgtcccacctcagcatcctgagtagctggcaatacaggcatgcaccaccacatccagctaattttgtattttttttttttttttttttttttttgtagtgatagggtttcactatgttactcagactcgtctcaaactcccgggctcaagcaatctgcccatctcagcctcccaaaatactgggattataggtgtgagccactgtacccagcccctcagtaatttattttgctatttttcttgttggatacattcaacaagggataatttaatgcagtcttcctgaaaagagtggctttgacttgagcttgaatttatttattgttaaccttgctaagcatatcaatttttaatttcacaaagactaaattcttcagtgaattattttaaatgaagtcaatgagcaatattagaatcaaaaataaaatagaattaattgaacagtattgttgtatatattttaaattatttttccaattgaagatatgctttaaacaaagggctcaagcaatcaggtactcaaggaaaaagaatttaatctatgctgcctagaaactaattggatgaatatgatcgtattcaaaataataggaatgctaagaaatgctcttaggaatactaagacgaattcaaatgtcgaaagcaaaggcttaactagagtgtctaaatgtaggaagtctctgtaaggaaaaggaaaaaaatttggttggtggtttgagacataacaaaaaaaaattcttctgggcattatgaccaccaacttcagggcctctaattagtctgacaaagtgacagttctacattctagttgaacaaataatgtatctaatgaaattcaaaatcgctatttttctctgagcacagtgagctgcatcattcacagctttggggtatttcaaaattaacagaggatgacttcagtctgtctgatgtttcttggttaacaaattcactgaaattgtcttgcagagcaattttaagcaattctttaatcttaaaccacaaagagaggtggaggtggaggtgtattaccttggtcctatggatgctaatgtgaagtggaatcttttatttctcaaaatggtcaacagcaattagtattcagtggtgtctttttattctggtgcccttgacccacctctgcccccctttctatattactcctattatatactgtaactggggatattcttgcttcttttccattctaattaaagcattcttagtgaacatgggaaccatttttcatttcatgaagaataattactggacctaggtgaaatctgcccattgggttttatataatttttgacaaatatttgcacgaattttgactgatctattcttaccatttctccgtgaaatgttggagaagttttcagttccctcagaacaataaacctaaatatgtacgtgaaagaccaagataaatgttgtaccaccttcaggttgtatttgctaatgtactttaaaatattttattttgtcactaatataagaaataatgatgactttttaacaatttttttttttatttttgcacatgtttctttcctagtcagagtttgacctaaatactcttctactacactagtgacaaccttgagaaatatcatttatttaggttggatctgtaaaacctatagctcttgttatacatcttgtttcttttttttattttattattattatactttaagtttcagggtacatgtgcacaatgtgcaggtttgttacacatgtatacatgtgccatgctggtgtgctatacccattaactcgtcatttagcattaggtagatctcctaaagctatccctcccccctccccccaccccacaacagtccccagagtgtgatgttccccttcatgtgtccatgtgttctcattgttcagttcccacctatgagtgagaatatgcggtgtttggttttttgttgttgtgatagtttattgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacatatgtgtgcatgtgtctttatagcagcatgatttatagtcctttgggtatatacccagtaatgggatggctgggtcaaatagtatttctagttctagatccctgaggaatcaccacactgacttccacaatgtttgaactcttgtttctttatttttctctagagtcctttctcagagccaagggtgtcttgacaagtaaaagagaaaaaagttactaaacagagagaaagagagagtaacagactaagaaagacagagacaatttcttcaaacctctactccaaaaaatcctcctcaaaatttaaacgacacatttgtttaaaacctcaaaattcttgcattctttcaaaacactgagctgttagattctaccaacagtatccgctctccaagttagttctttaggttcctgtgtgttggatggggaagaggtagggaaaggaggctagctaccttttatgtctgtgaggaagggcaaaggtctggtttggctaattttaaacaacattgtttaaaataacaggaacttgaactttggagacagttgctagattcaaacagcagcacaaacccctcattacttgtgtggtcttgtgcaagtcatttatgttatgaagcttcagattccttgacccacctacttcacacctaggactattaggaggattcagtgtgatgatacatacaaagcatttagtccattgcctggtgtacaataactgcccagcattaactctgacattgtagtgtgcttatgtttacaaatgaatatcaagatgttagcattgttcaaggggcaattaaccaaagtcattcattaaagttgttgagttgtttaataaacaactcaattaacataaagactctttaccaaaactttgaactttgttcaaatttcattcatccaaaagcagttgctgagctctttctagccaccaggcataactctaggtcctgtgcaaaacaggcttttggagcagatggcgtgcattccctgatggaactgaaggccctggccaccattgtggtgaagttcataactgcacttactgcatgttctggctggctacttaagaattccctaaggagatattggatagatcaaggtacttagagcttggtttcaccttctagggggagaaagggttgctcttaacaaaaactaggacaataaatttaaatgtgtttataaataatgatgtaagacaactatgtcaatgttgttaaagttggctgttacttttaagtacaaaattgcatattccttatttggtgggattactgtacatagttatttttagaaatcagaaaagttaattgatttactgtgattctctcgttttacaaaaatgcaaattgttttattatataagaagagtccattttagaccaaattcattcccataaaatgaaaacttcttggaaaaacaacaaaaaagaactttttaagaaaatgtattgattggtaactcatgacatttcttttctgttttgctttttggctcctgtgaatctcagaaaaaaaaagtctgttgctactcaggaggctgaggcagaagaatcgctcgaacctaggaggcggaggttgcagtgagcagaaattgcaccactgcactccagcctgggtgacagagcgagactctgtctcaaaaaaaaaaaaaaaaaaaaaaagtctgttgcttgacaatggctaaccttagtagaggttttgtggtacagttcactgatctttttccttcattattcagctttgttttcttgagttttatattaaatgtttttaaaaatattttggtaattatgcaggttaataaattataaaggatatctatagttttccccatctctttctggcattctaatgacatgaatgcagattccttattgatccatataagaatgagctcccagaagtgagtgtaatggaatcaagtagccagaaatacttagtaattggattgtttttcacattctgcactcaacttttatggaaaaaaaaaactcgaatcaaagtatatcaataagatgataaatccattcattccttttcagtatccagtccagtccatttaccagggagtagccaccaccatctgtgcctcaatattttcaaactaaacaacaattgtagtttctgtgcttaaaatattgatggaattagtgattccccatctccttcgtatacatttcagactctttatctgtcctacaagaccagtgtctcccacccttgctgccttgcttttaattcctcaaacagtgagatcaccatagagcttccggcccataacaggtcagcaaagtcttagtcatttaacaggtccaaacttaaataccacttccttagaaagcctttcttctttcaaccaaaattaagtcggccccctttaatgatacctcttagcacctctgttctccctcctagcactttgtgtacattttaactacatattgctttctatttgtttgatgccagtcttgctccacttgacaatattctcatgcccataatggtgtgactctggctagtttgttcttcattatgcacccatcacctggcacgatgcctggcaagggagtaaaggaggatgggtagatcagtttttcagggaatataaaaatgacagcacagttttatcacaaatgtttaatctttctgtatttccatatttatagcttggagattgcatagtaaacaggaaagaggatgaggttttgaatcaaaattctcatgtttgaatcccagcctggcacttagcacaatcacaaagaactgtaggaggaatgcaatactcacatcatctaattcatggtatggctgcaaggccaaatgagaaaaatggagatgcattcaaaaggtgagagctacatgagaattcatgaacacaaagaagggaaaaacagacacagggcctactcgagggtgaagggtgggaagatggagaggaacagaaaaaataacctttgggtactaagcttattacctgggtgatgaaataatctgtacactaaacccccatgacttcagtttacctacataacaaacctgcacatgtacccctgaacctaaaataaaagttttttaaaaagtaattgaaatgttcgtaactcaaaggataaatgcttgcggggatggataccccattctccattgtgtgactagttcactttgcatatctgtatgaaaacatctaatgtacttcatatatatatatatatatatacacgtatatatatatatatatacacatatatatatatacgtatatatatatatatatatatacacatacctactacctaccctcaaaaattcttagaaatttttttaaagaataaaattagacccctatctctcaccatgtacaaaaataaaatcaaaattggttgaaaacttaagtcgaagacttcaaactatcaagttactacaagaaaacattggggaaaatctataggacataggtctgggcaaagatttcttgagcaatatcccacaagcacaggcaaccaaggcaaacataggcaaatgggatcacataggttaaaaatcttctgtacagcaaaggatgcaatcaacgaagtgaaggaacaccccacagaatggaagaaagtatttgccaactatccctctgacaagggattaatcaccagaatatataacaactctataggaaaaaaactaataatccaatcaaaaaatcagcaaaatatttgaatagacatttctcaaaagaagacatacaaatggcagtcatatgaaaaggtgctcagcatcatcaattatcagagaaatgcaaatcaaaactataatgagatttcatctcaccccagttaaaatggcttatgtccaaaaaacaggcaataaataacaaaagctgtcaaggatgtggagaaagggaacccttgtaccctgctggtaggaatgtaaattagtacaaccactatggagaaccatttggaggtttctcaaaaaactaaaaattgagctaccatatgactcagcaatcccattgctgggcatacacccaaaagaaaggaaatcagtatgttgaagaaatatcttcattcctatgtttgtttcagcactgtttacaatagccaagatttggaagcaacctaagttgcatccatcagcagatggatggataaacaaaatgtggtacatatatacaatggagtactattcagccgtagaaaagaatgagatccagtcatttgcaagaatttggatggaactggagattattacattagatgaaataagcctggcacagaaagacaaatgtggcatgttctcatttatctgtgggatctaaaaatcaaagcaattgaactcatgggtttagagagtagaaggatggttaccagaggctgggaagagtagtggagggttggggagaggaggggatgcttaatgggttaaaaaaatagaatgaatgcataagacctactatttgatagcacaataaggtgattatagtcaataataacttaagcgtatatttttaaataacttaaaaaatgtaattagattgtttgtaactcaaaggataaattcttgaggggatggataccccattctccatgatgtgcttgtttcacattgcatgcctgtatcaaaacatctcatgtgccccaataaatatacctcctatatgccacaaattaaaaaaaaattaaaaaattaagaaaaaaattgttctcaagtgattaaaactaagatggctgggtaatttaagctctgtattgggtataagcagaacatactttttctaaaccttgtgaattttttaagtggttacaaaatattataggatcagactttgtaatttcataaatattattattacaaataatgtatccagagcgatctcaattatgaagtcatcaaggatgggtaagaaaattacagagagaagcaataaatctgaatgtacagtgcttatcttcaagtaacttaaaaggaactatgaacaaatgttcatagttttttgggatacattaaatgacttagtgatacttaagaagatactttgattgatgttactaagaaataataaatgagtaaagcatgattgtagttatggtgtgagtaatgatatgacaggatcatgtgatagacattgggggtaagataaagatcataacaatagcaaacacttatatagtacttatgatgtgtactttattatattatgtatatattatattgtgtaaccacttgatacattaacttatttaatcctcccaaccacactctatgaaatatataccatcttaatctttctttcgttgatgaagaaactggggcacatagagattttggtacttgctcagtaagtagcacaatcaggatttgaacccagataagttggctcttaaccaatacacagatctgcctcttttgtgatttaatcaaaataaactctaaataaagacattacaataaagacattaattagctgctaatcagctaattaagttaaaaatgtaaaaagtgctaattgaacataaaggagagtgacaaaagtgtgaaatgttcaggattatctaatataataaaaagcttatcaaaggtaaaaaagttttcattggaaaagattcatgaacaagcattctagaaattaagaaatggtaaatggccaataagcatgttgtaaatatttcaatcatagtcttttggttttcagtgctatctatagactgacaccttccttatgtatatgctcaggcctaaacacatgaactccagtcccccgtagtcaatggccttctaaaaatatcttaggcaatccagaaccaacaaattttttttcttcctacaccaagtgtccctcccttagaccagaagcttaggagtcaagcatccttctttcattctctacatccctacatctgttccatcaccaaatcctctatgaacaatactttccagactcacgtcaatgaggcttctgccttgggtctgcttcatttgtgcttctcccagtgatctgcaaatctcaactcagataaaacctcatcagagatgccttccctgcctatcgcatctaacatgctaactttgctccactccctccctcatcactctcaatgcccttatattagaaatgcttctttttttctcattaaatgttagtagactttatttttaagagcagctttaggttcacagcaacatcgggcagaaggtgcagagttcccatttatccttgcctccacacgtgtatacccttacccattatcatcctcttccacagagtggacctccactgacatgtttttattacccaaagtccatagtatacactaagattcgctcttggtgttgtacatcctatggctttaggctaatatataatgacatgtacttaccattatagtgtcatatgaagtagcttcactgctctgaaaagcctccgtgttccatctattcattcatacagccctcccccaacccctggcaaactctgatcactttttatcgtctctatagttttgcctttatctttttttgtctttcatctcacccctcttaataaaaaccattttaatttgttcattactatattcccaggttatggaatagtgctaggcatataatagatgacttttaaatagctgctgagttaatgaattattatatatatacacacacatacattatatcagtcatatgtaattatatacaaattatatgacatgtagatatataatatatttaatgatatacttgtattattattatatatgtatatatagatatatataggcattatataaaatactcattttgatggggatactgggaagtggaccactcatatcttagtgatggtagtataaattcaatgttctggaaaacaattagtcaactaatatctgaaatagtagagcattcatcaacgtttacccgataactctaaaaagtgtccctaaagatgcatcattctgtatccatcaatgtcagctttgttaagtgaatgttccacatctataaaaatagtacatgcaattatttgaaaagttatgctaccaaaaatactgactggcatatatagtaaagcaaataaagtttactaaataatatgtaagtattcatcttaatgtttttcttaattatgtgcacatatatttgtatagaaaaaagacaggaaagattatctataataattttaccatggctatctctgggtagtgtaattatggatcattgttttcttcatttgttttataatctttaaagtttatatcataaacatatttgtacttaggaaaatacagatagtacttttaaaagagttctgtttagttctccaagaactaaattttatcatttgtttaataagtatttcatgagcaatactaaactctcaaaatttgttaagtgctctgaagtttacaaagataaataaaaagcatatctgctctcaaatggtttatgttatcattaccttggtttatcatgggacaaagcaataattagacttaaatttaaaatttaatggggttttgggagatgaactatggtcttgaaaacaaaagggacatgtatgaaaccacaggtttctatctactattcattgagacgttgcttagccttttctaaactcagtttttatatctgtgaaataagaacattgagagaaacgaatgataaaatgaatgtactctaaagtagtatttcagatttcatttgataatacctccaagcaattaatctcacttatgttaaaaatatttttcacatttttttgtaatttatttgtaaatagaaaatatgttcgggattctaacaattgttgggataatgacagaaataattttctctgcagatctttcccccatcaactcatccatctttcccccatcaactcatccatctttccaaccattgattcatccatccattcatccagtttttataggatctttcctagacaaagcactgtgttgggcaccatggtatctctttaattacttttctcctttaacagtcctttaagactatgtatacattagaaaataattaatctggtatggtcagctatctatatgaccattttgagtcagctacatagctgatatgaatgaacttgatgaactccaatattaagcaggccaaaattaagatgctcagtgaagtttcagcagcatcacttgaagaaaggaaagtcagtgccttcctgtgttgggctgtggcccaaacacacaaggagtgtaagtttaaaaggcattctcaaactggaacacatccaaatcagttaacaaggctagaagatggttgagaaaacatactatatggaaactagttggagagaacagagatgtttaacctgaaatggggaaatttagtggaaaggaaggcaaatgcttaaaaatacctgaggttctagcccacgaatggtaccagaggcttgctctcagggattagaggtaaggttctaaggagttcagtgttgttagcatgaccaaccatatgcactttttgcccaagatagtcccagtttatgcctgctgcatgcagctcagttcactcctattaattacttagagtgccccatttcactcagaatgtctcaatgtgaacaaaaggttatatttgccctaagttttgtagaacccatacaattctttgttctacatcagaaagagctttccaatgataaagactattcaataatgtgatgggacaacttgccaagtgactattttcctgtcactggtaaggcacaagcagagacctggggtcacctgtctgggatgttctaggtaaggattccttatttggtgagaggataaagttggtgacttttaagttttctgccttctgattttaagattctgttgttttgtttttgaatattctatggtcaaatatcagttccatgacatacctacgaaaacacaatttttaaaatatactctttctctcgctaacatgaagacttctccattttacatttcattgaatttctgtggatgttgactaattctggagatgtggcaaattcatactagtagttctgtgtgtgataccttgtggaatgatgggaatccctgctatgataaagaaataagaccgggaggtactgtttaagaatatgacctggacagaaaataaatccaacatttattgaaatttgtttatttaatattgtaaatggtttgcttttatatagatttaatatatttaatagttattctatattataaatcattcactatagcaggctgtttcagggtgtaaaattaagagcgcactgcctttgaacttaaacggcccatgttagaatcctcagtgtgccagttacatcagttctgcgatttgaaatgaaatatttaacttctctctgagcctcaccttattccgtatatcctacaaagagaaaacactacaattttggagtgtaattctgaggattagaaataattatgttaaataaccttgtacacagtatgctttcaaaaagttcgctctggtgaaagactgttttgtgaacatgaaatctattttaacctacttgtcactatttaatgctgctctgtttgtgcatccttgtgttcaaggttgactgtccatttgttagcacatctgcatattcctcataattaatatctttttaaatgacatatggtttagtgactggaaatcgagtcttgccttctgttttcaatttgttcatgactcaatgactcaatatatgtgtctgaactttaattttccattctggaaagtagaatttaaaacccttgctcatatgtagctatttcggaaaatgatgaagaaatgtgtaatccaaggattttgaatatgtgccaggctattcagcgatgcagcatataggtaaaaggccgcagtttctctaatgttaacagagaagcctaaatgagaatgccaaaaatgtaatccctgaagtgaggggataatttggggtaggctagagtcagattcctagtgaattagcaagaagcaccacatctaaatggaatgagcacaggaagagttggtgggagccctagggaatgaggctgagaacatcattaacctggatgaacaactgatagtacccccagggcagtgcttctgcaagccagggatctctgaaagacaaggcccagtgcacccctggaagtgagtttctaacttccgagtcccccgtagcatttatacctcttttgtgctgagtactctttttttggtgatacagttatttgagtcaggtctaatctgttaaacataaagtagattatttgattccgccttctacctattctgccctttccctgcctctaacaagaaccttgtgcagagtggtattcagtgtcttgtattatagaattgaatttgatacaaaatattacaggcttatttgatattttaatgcagcattttatttcactattttgaaatgcacacacacaggcaaaaaacaaaacacacctcaaaagtaacatgttggtgggatgtcctgagaaagaattcagtgcatatggaaagcacagtgaattcattttctccctaaaatattcttcttcttgtccccacagacttggtagccaccaactacgtttgtaaagcctctgtttttgcctttgagagctcactcccagagttttataaatctgcagggagcaaaggtttaggacatgtgtaaataaatcattttatattttttcgtttgttttattttgttttgttttcttagagaagtttaggacatgtataagtcattgtctatttggtgttttgttttcttttgtttttcatatagatgagagtccagtggcgtatatcatttttaaagtttaataaaattatacattcaaaagattataccatctcaattattccaatctgtgatttaatttattgcttaatgttttgtatgaatttgattttctgaagcaggttaaatttgaaattttattaaaaacccacttcctttgagtttatagattgggatagctgttttatctagtcgctgtgtagaattagtatttactggacaagatgtgttgattcaggaggttgtcttggagtgtttgccccgtgagggtcatattaaacttgagagaagttctttgagcaacagagcatcttggagacaatatatcaagctgatggatacagggctcttctgttaagaaaccagcagtggaattatggctggctcccagttattgctttggtgctaaggagcctctaaggattaaatctaggataaaaggggttaaacagaggggaaaggaaggtttccagaattcagtgttactggaagcatacagaatgagtagttatatacaaataatttaagatgaccattctgtttggaaatatttcacaatttaatatattcaaagtgtaccaatttagtggagcatattgttttgttattactcagaagagaattcgtgacatcttattattattataaagcctactttggggcacttcttcctactgtcttaatagaaaggtaatgtagtttttaacacataaggggttttgtgtgcatattaaaaactaattttttcagggctaatgacttgaaattcagaatttggattttcaattacattatactccttgatgtagaaaaattagacaaaaataatcaaaagagagacatggttttatatgttatacattgtatgcattttgcactttattttttgcctgtgttttcacagtgctcttttttctatgtatgcacttattataaatcaattaaagtatatatgtcaaataaattatgattgttaaaaaccatttgtgttcatagataaaaatatcaattaaaaagcctttagcaatgaatgtccttcaaaccaaaaatgtgaaggtaagaagtggatagttggccctggacagcaatcttcttgcactttctagtcatgccacacttttactaattgagagaattatttcatatcatttcctctttcttcaagcctccatttcatccacccaatttgtcactgagcctttgcttttattttgctcactaagaaactgcgcatcatcaaaggagatctttgctattattccatcactgaatctactcactgctctacatcttcatctgtgcattcacttttgcacaatgggagaactatccctgctctgtttggcagccagtgtgcactgactctcagttgattcaaatgtgcactggctcacctctctcttcccacactaggactttgctctggcaattctttcttttacggtatcatttcccctaatctgtgttagattcttccaacaaacatgcctatatgctgcaacatcttccagtctttagaaaaccttcctttgatatcatgagcttttctagctgctgccccattttctaatcccttttagaataaattccctctaagtgttgtctaagctcactgtatctgccctttaccccctcgttgtcttcacaaccttagctcagactgctatgcccagcactgcactgcatctgctctttgcaaagttatcaaatatctgcacttggccaaatgcaaagtttcaactcccagtcttcttcctccttaaactctcagccgagttgatacagctgatacgttcttcctttttcatgtgccttctttctttactcggcttccagtctgcaccttctcagtttttctcctacctcactgaccattccttctcagtatcctttcctagagaggcctcctcctgacctcaacattttggtggattccagggcttggttctcagacctcttctatactcattctatcaacactcacttcctagtttatttcaccatctcagcctttaaagatcacatatatgctgacctacaactcctatgaaggctacaactcctatgaagacttttcctctccctctcctccttagtccgtgttagccacactgttccttaaacacaaccagaatgttttcctccttactgcctttgaatgtactgctatctctggctggattactcttcctccagacattcggatggctacctccctcatgccagtgaagtctctgttcaaatatcactgaattgcattttcttcctataatcttcccatcgaattgaagttgttacctagtaactaaaactgcccaattctttttaccttctctttccttacactgctttatttttctacaaagcacttatggccacctggtattattgtatacacagtattcatttgtttaccacctgctccctccacttgaatgtaagctacctaggggcaggagtggtgtctattttattcagtgctgttcttcttccacatgaagagtactgcttagcacagagtggagccttaataaatgtttattgaacaaatgaatgaattattaatgaactcaaacccattacagcagattgatgaaacatgtaatctaattcttctgttctcatcactggtcattcattagcctcattgttcacagacagcttcttctgaattggagagtatgtaaaattgacacactacacaaggttatgtataaaataaagttgaaaatggaccctgatatttcatttgttctcattattttgatcacttctccttcttcaccaatggcctctggtaatttgtggtcattaggaacctatattacaataatcagaatgttcccaacaaagtatattatactagcaattaaattatgctaaagaaagttcaggtcagtccaatgtaataatagtaataatagttagtgactaataattaccagggtctaaaatcaggtgctttatttatatgatctctgaacttcacaacaattctataaaggaaaaatattatacctactttagagatcagaaaatataggctcggagtcattaggtcattttcctaaaggcagagttttgctgaatttgctttcaagtttctgaatagctttggaacaaactgatatgatttggaacaagctgatatgacaggctcatttgagttataccagttggaaaaaattaattaaataaccagagtcatcttatcaactttttttagtagaataggctttagttttacacattcctgttaggccttctagaaccattcaaagagatttccctggtagattgtaccaagcaggtatgttgaagtcagaacagatttgccggagactcaactagactagaaaaagtggtatgcatgttccaacttgcaaaattgagtaagggcaggagaagggataactctgagaagggtaattgtataaaacacatagggaaaaaagtttactttttatattttcatgggtgagcattaaggctggaatacactgtattcagccattcatgtttatttatcattccagaaaaatacaattttagctaacttcccttcctccaaaaaaaaaaagaaaggaaaagaaagccattgtgttcacatgtagtggtgtgattaaggcagcaatggatgatatcggggggaagaatatgagatctggactgcttcagtgttcaattgtttggtctgttgaacaaagagttaaatgaaaaaggtactttaatatttgcttcactaaattccctccatgttttcaattagataaacagaagtacaggtgggaatgtgctgcatattcatttgtcttgctgtttgggggccggcttttaagactgaaatactaatgtaattgtgttgaaatgaacaataaggaagtacaggagttcaggaatgaaaatgttaaattaaatggaccatgtttaacattgttgttgatcctgaggaacagtttttccagtatatggagcatttcgattccatccagcatatgttctccacagttttctctgctctaattcatctgtgtttttcgacagctccagatggcgtgctgcctcccaggctttcatctgccactccaaccagtcttcaggttgtctggtctacaccagctcgtaataacgctcctggctctcccagataccaactccagatgaggtctggcgactccacccatggatttctagagtgagcattctactttgtccattctatcagctgggttatacaatatagacataacatttttgaagagtaggtcagttctcatttgcaaaaaatataggttaccttttaaaagtacaaaaaaaccccaaacaattagaggataatcatttgctttgcaaaaatatctatttttcatttatgtagcatttaaagtaggatttcttcccactgaaacttttcatgagcacatgcattacataaagcaatgaaactaacaaaatgatgtctgaactgtcgctaacaaattataatacctattctacaaatccacatggcagtcagtctcaatactactaggatttacatctcgtataaacacaagattacagactcagccaatggctacttattttaaaagagatctcatttgatggcagaaaattacaatacttaaatgtatgttgacatcctctaaaatttttttgtagtaagaaatttacttgcttttatttctttgaatgtcgaaaacttcctaattgacatttatttcccatacaggttattttccaatccttctgcatcgttaagctatgaagtgagtgatctccaaccgtacacagagtatatgtttcggttggttgcctccaatggatttggcagtgcacatagttcttggattccattcatgaccgcagaggacagtaagtggtctgaacaatacacagccaaatgtcttctacatagggagcttaaaatgtcttcaattttttccaaagcaaagaaatgagcctcccttatttacttgttgtttagtgacaataaccttttctagggcaagagagtgagcaaaggtggtcagtctctccagaaagaagaataatgtggtcttggagggttggagggttaggcctacagacaggacaaagtaattcactataaattatgatatggccccattctatccttcagggtacatcttagcgccctgcaagagaaaggttgtcatcttctgctttatgactgaatgttctctgtttcggagaaattctggcaggcagaagaaaatgaaatatggaccttacttcatgaggctgcttacatatacttgttcctggaaacaggtttcattttcctgcttctactcataccccaaagacagccttcagcatagagaagtataatctgatagcagtatattacaaaaggtggattaagatttctttattcaaccaataaagagaattttctagttgttcactaaaaagttatttttgcatatatttgctagattatatttgggaataaatacatgactataacatttggttttatacaaattacctctataaaagcatatatatgaaagtagaggggtttttaaagaaaagttagaaattaaatcaagctacacagagtgaataaggacattgtatctttgaacagttaggttttttgagttaatcttgtgaagtcttttaatcataggcttcttaggcaatgttctctgctggcccattgccatgctggctctatatccaatgagaacgttaagtgactttcaaaagcctagatattaacacaaaagtatggtatttgcaacaatatcaattgtttattaaatgtattgttttatttctataatacctttaattgcattattttagtgaagataagacatcaaattagacattatcagtacaatctatcttgtttaaagttgactttatttttacaaaaaaaagccacctttatgagcaataatgtatgttacttaattcatttcttccaattcgtaattactccctgggagaaagttagctactttgcaaggggacactcagtgtttttgttctcaagggtatcatttagtaaattatcagcacagtacgataaatggcacccaaagtccagaaagcattaattcaccaccttttaggaggaacattacatacactctggggaatctggacaccatgatcaccagatttatggactgaagacttcacactcaaaatagatttttgaagaaacatttgaaacaactgaagatagatttgtaatctccttcttatatatagcagcatgcttgatggcactaaataaagattagccaaaaataattattcaacccactgcagaggtgatggctcaatagaatgcttggaagaagggagaaagcattttttttttggcacagcattctttattctcctagagaaagggcaacactcaaacttcctcagcggtaatctccccacaattttcactgaatgagggccatgacctgccatctataggcagggaggtagcacataaataagcaaaagtccaaaatattgtaaaataccaattagcatagcatcctttgttgagcaaacttacctttggtctcctttttactataaaacaagccttatagaccacacatacacatcgttagaattttcatacccagagaccctccattgttgtggtatttagggcttgagtttaaagtgagtggtattaacccttcattttccttaagtaagaattagtaacacttgaataaatagcaggtatcaactcataaccattatttgtgtttaaatccgttccccaaaatgaatgaactcttccttcctctgctttgtgtatacactgtgaagtcacatacatagcaaagaactggaaggaggccatgtgtacctgcaggttacgttagcagtgcacctgagacatggtgacagggtactgtatattttagatgtcagtggagatggatgccatctctgaaaggatatgcaattgagttgacaaagactgagtgattggcattgggcacaagcagtttttctgtcaaggctacaaagcattgcttataaaaccacccatgttgacagctccatgccagaatcacacttcttacttgatcctgaccagcacctcctgctcaccaaagtgcaattttctttctctttctttcttctttctttgtttctttctttcccctctctctctttcactttctttctttctcactctctttctctttctctctctttctttctttctctttctttcttttcttcctttccttcattttttgagacagcgtttcactctatcgcccaggctggagtgcagtggcaccatgtcagctcactgcaacctctgtctcctgggttcaagcaattcttctgccttagcctcccaagtagctgggattacagatgcccaccaccacacccagctaatttttttaatatttttattagagatgggtttcaccatgttggccaggctggtctcgaactcctgacctcaggtgatccagccgcctcagcctcccaaagtgctgggattactggtgtgagccacctcacccaacccaaagtgcaattttcaatgtagaaatttcacatatcgtcttacagaacgaaacagagaagtcgcctcgtgcccacatttaaattccataccatcaacaggcacctttctgcatcagccacagcctcacagctttccagtgccaaaatgggtcaccaatggcaatatttttagtgtgacatttcaagacagtgattttcagcaagcctgtgacacaggtgaaaccacaaagagaaatctaggcaggcaatgagctacagccagagaagcaaatgcatgggtgcagagaagttatcatggacagggaaacaggatgtgaagaattttaatagatttttttttcaaataatttgtcatttacaccagtgtgccaccaatatccagttccatgcatttttaaaaatctagtgtgctgatgccaaataatcataatgcacatttcctatgaatattttaaatcctgttaaatgtgtgttaataaaagatgtttgttccagccaatttggtcagtgtagtgtttaactggttgcaaccagataaatacaaacaacacattattttttaaatgtgctgctggcagtccaagcacctggcatgtccacagcttgcaaaaatgtcctaagattatgttaggcttgggagcatgtgattaataaaatgaaggcacttgcctagcagctgaaaatgttgatatcttgaaaacaaagataaccatcactcctgattatatgattgttccttctctctcgtatgtttgcaattgttttctgtatagtacatgcatgtagaaattagagttggcagggagggcaagtttttcaaacctcagcttaaatgtggatgtattcttttgcctaccgaaatcctgccttgtgttaactatgaattaacctactttttcttaaaattgtggattccccagcccaaaaaagttagataatctgtttctcttaagatttcccaggaaataagattgaaatatggaatatctaatttcagtcattttaatgacaaacatatatggcatacacaagcaattagatcaactaatgaaattgaaatcattttctaaaaatcacttccctaccctcaaaaaaaaaaaccccaaacttgaattcactttagattttaacaatttagttgtcatatatttaaaaatgtttgatcgtttcccaaatttgtagtttaaaattccatatttatatttttaaccactagtctaagaggcactactgcataaaacctgtagaattcgaacagtttattctgtaggtttacttagacaacttttcatttgttcattattttgatgacacagtgatattttaagtacagttatatgctgcacaacatttcagttgatgatgaaccacatatatgacggtggacccataagatgatgatatcatatttttactgtaccttttctgtgttgagatacacacttatcattgtgtgacaaatgcctacagtattcagtacagtaacatgctgtacaggtttgtagcctaggagcaacaggctataccacacaaactagctgtgtagtgggctataccatctaggtttgtgtaagaacactctaggatgtttgtacaacaatgaaatcgcctaatggtgcatctgtcagaatgtattcctgtcattaggtgacacaagactgtaccattgccatgctatatttgctcattgcattacatcttgttattttttcacatttataattgcactgtgaacagaggagagggcaatgaaggaaattgtcttactgcctgggtcctgctttacttttcccctcagcaaccttcatccatccttcagatactcacagtaatttacaaaggaacagaggttcttctggagtaagacagaaaggcaatgtgaggtcaattgaaatctagatctaacagaacatgcttcttcctcttttgttgcctgacataattctacacattcatcaagccccagctcaagtgtcacttcctctgtgaagttttccttcttgttgctcccttagaattttggtttgtgtttactagtgaatcatcaatatccccttctgaattgtaacgtctcaagacctagggatctgtctcaactatctttctatcaccagtgtctggcgaagggtctgatatagagtaggtgccccaaaattcttactcaaagtactgattaaaagcagagtttgattgaagtaaatccacaaaaactcaatcaagcaaacatttaccgtgtacctactgtgtaccagggactaaaagagatatgaaagttgcaaggatggatatgatactgtttttcccttgagatttcctctgtctggcaaggagcacacacagtaaaaccatagttagagtgaaagagctgagttgtccatgagagcaagctcagaggaagggcatggcccctcaacatgagggccaggaaagcctacccagagaagaccaggagaggaattggaaatgatttatatttggagtgcactttaatatcaaagttcaaatttacaccatctccacttgttcagggtaaggctggaaagcaattgctgtaagagagcactgacatatgagacctgaagagggactctcaggttgtcctgtcggtcgttccagcctctgagtatgaggcgaggagggtggggacaagaggtgaatgtaagagagggacatcccaaaagtgattctcatttttttaccttggtcagaggcaggcttctggctgtccctctgattcaatattggctgctgtcttggctaggttaacgaatgttctagttagagaggcttctgccagccccaaatcatgtgctattcggaatgaaggggagggatgtgtagaaagaattctaaaacaaaaccatttttcctgtttttattctcacaacctgtaataagagtaaaatactctgagaccgtgtaacagaagaggaaggaaacatgtggtataaaatttgataaattgatcaagataattctagagtaggacttccgaatcatttaagtgcacatatgcccttaagattactgaaattttaaaactaatattgcatgacaaacatcttatgtttagggcattttagaatttaaagtttcacttgcatccttaaaatcattctacgcaacacaaggaaaatcggaatatttttaaatgagagtggaacatatttatatgagtacattttatttaatgaagaaagaggaactacaagtttcagtagtgctacacaactattttgctttctccattccaaatatttttccagttgccttaagtactaacctctgattgctgacatgtttttcctttcaaacagtaattcaggtatctattttgcatagaacagaagacccatgatcaaaaataacatttataatcttctgattttgagagcaaaatggttctgcatgttttcactacatactttgttttctgttgcatagattttctccacaaattcctgaattttcagaattaacaaattcaaatatttacaattatttttatattttatttttataatgtaagatcaaaaggaacttattcaagccaaaaatgaccaatacggaatcctttgaaaggatggattgattaatcaaaaattctatccaccttgcctcaatttcccacttaagctctcgaatctcccctgggcacttaaagcacactcctcttccaaatatagagtgcttgtaatgtctgtgtttcttacagctgaagactgcaggtgaaagtaatgaaaaatcaagttttttatgtttactttaagaaattaatgaaaaataattttatcatagctgccttattatcactacttaaattttattgagggtgtattatatgcaagacactttagcaggaaaagtatatcctctcattatccagaaatgctatctgctggccttccactatttttaaaaactattcttgttctttagctttgaaaaagttaaattgtcaatatttgaaaactctcagtggactatgtgagatcattcaaagataattgccacaggttgatatttaatggcatgagtttagttttaattctcaaatcttaaattcttagagagtcaagtatctaaaaactgctggttattaacaaaaagatggatgtttaccataatcattttctatagcattttctatagcacctgcctataaaagaacattctgcaatgctaaaacaatacatagattcatttaatcttgttgtcttcctcattttgataatgtacctgtaaacagagttgatttgctatatttggaataattcagataagttttgcccaaatataaggagtgaatgtgatgacctttaggttttttaggatgttttcctgacttcatgaattctcacatcaatgcattttattttctgcaccaaattatcgcagatgcatctactacgattcaccccacaatatgccccagctctagaggttgaaacattctttctaaacaatactctcctgatatcaggagaaatagagaaaaatagttcccgaatattggttctcctatttgcaaactatcaaataatgtccttccaattccaacagccttttagccttcagaggtttctttcattaaataatgttacttatgttatacagcccatttccttttttatcagagtcaggctgaaagttcatttttctgcaaaactgcagtgcccattcttaatttttgttttgagaaataactgttgtaccctctttattatcacaagattaataatatttctttattttattgctcctcttacatttggatcttttattatgagctgtcaaaaattcttttgggaagtagttggggtataaataataaatcgataaaagaattcatgattaaagacaagatagaatccattattctgttaacatatcagtagtgaataacaaaaggctacattgacaattagcatgcaatatattgctttatataattatacatccatatatttgccactttgatttttaattcactggtaaatttaggggatactcatttatggagttaatattaccaaaaagagtttttaaactgagcgaggctttaattagaatggtaaaatattgcttcagggcaacaatgagaatgtaacaagaaaactgactgatcagtcatgggtaactcgaatagcaaacaagtagagaagactcacaaaaccactgaaagttatatacacactcaagttgtgagtcattcaaactgggtattcatacacatgtatacaaatacaaacaagtgtgtgcgcacacaccctttccaatatacacacctgaatataaaactaaataagcagattcctctgttaacaattttattactctattttaggctggggctgaacttttgaagctgatgagcaaaatagtttcccataaaagataatttcatttgccaaaatgaaactactttccgttattaatgttgcaatgaaatggtttgaaatatgagtctgtgatctggacagaaaggatgctcctgttcccagctccaagagggagttctctaaacaattacacccacggagagcgctgtaaggttgtattttcatcaccggccagctgagctgtgtgcctgtcatactcccagtctcccctccagtgacagccgcattgacaacatgttatactccacattgattttacagttaaggagctgattgtgatatatagagattttaagaattcagctgagaggctgacttttgccttttatcattccattaaaattttataaccatctttttcatgtcatttcatccatgaattcttactttagaaagtgatagctactgctgtgagcataacttttctcatgttcagagctttttattgtattagcaaactaccccaattatagttattactcatgttttacataattgtggtggccctttcaaccatgcagttgcaggccagttgatttgtatatagaattagatgattcggcttatcattttaaagcactaaattgaaagagtgccaggagtcaggttttaacacttccctagccaaaggagctaattaagctgctttcagcttcctctccagaatcacacaagttaaaggacccttctgcaacaagagcagcgaatctactcagccagagcaggaagctaataaaatgtatgctggcttttaagggggaaacaaatcatgaaattgaaattgaacacctctcctttcccaagataagagatcatctttaagaaaaggctgtgtattgtgggggtttgaagtgcaagttcatctcattatcatggatgtttcacccataatactatcatcatatgcaggagaaataaaagccttatcccccaatcacagagaacaaactgcatcattgttgtttcttttccctgaagatgctcacagtttgatagttcacatatgaggaataattatgcaagacccagatgaaaaccctaataaaaaatattctgatttttaagtgtatattactctctttggggaagagagggtgagataaggttagacattaaagacttgaatctccaccattgattttacgaaacccaatctcaggggatttgggggtttttttagatttcaaaacaacattgatatcttacaagactcgtacttgcttttctctgggaaatagccaaatctagatgacaagcataaataagaaaggagctgtatccccattttgatataataattgctactgctactgtataccagagagcaaaagtaagaaatggcatagtggttttaagaaagctttaaaatgaaagctaacaagagactgaaacggaaagtgtgatttataccatgactgctggttttagggttttttttagggatttctcttcaaataggatacattaccaaattgtcagaaatagcttgatttcagagttagtgcactataacatcttttgcttcgaaaagtgattatgattctaccatcagtccagttggtgacaaatacgtggatcctgttgtgtgaaagtgtactcatataaccaactattattgcagtcactggccctgcaaagcagtggttgcatttaaaatttcaaccttctttgtaacactgaatcgcatacacacactcacaagatcaacgctgttttaaacaattactaaatccaagtatatcttttttaaagattttcaataaaatctaatgttcacagaaaaatctcataaatgtcaaaattgctgtgggcagaaaaggggggatacagtattttcttgatctgttttagcaatttatagatttcaggccgtggtttataagaatgctaaatgttctggaattacagctgttactgatcagtgattgagccagatttgtgttattgcaccatgttcttgcttgtacctagagagcagtaaagcctcaatataataaaaagcacctgcattttaaatgaaatttcaattgaaaaacttaacagcccttcaaattgcagaatttaacgcagcccagtaaagcttaaataacactttgcccccgcaggctgaggggtttgcattcaaggtgacttgattgtgtcgcatggtgaaattatttacaattaaggaatttctctggagggctgcagaatatttgctgttccacaacacctatgcaggcatatggtgggcctttttcagtattcatggagcctcctgaacctttatgataattgaatcagttagagtgctgagtggagcaagcataaaacctgttaacctaaaggtcagatctgtgcattgtttatttatcagtaggtgaaagagctaaatcggcagcttctgtcacagccacagtaaaaaatcgcctataatattaacagggagtagataaattgcaaaacatggattagaatgataaacagaaccaagtataatatagaatatataatgagagatgctgaaggattttactgggctgtaaaatatgcaagtttgttatgatagtgttattgattataattagttactggggctctagaaaaaaatgtaggggaagctagaactttagtaacaactaccctcttgtatgtttattaaatttatttttttaaatcctcattttttaaccaatggcttgaataaaaagacatgattttgataaagctgtcttagagaggaaaatgatcattttagtttcataatattcaacaagtatttcacacgcaaaatttatgagcaaagcaatcacagtccttgtctttatggcacttatttatttacttattggcctttaccaagtgttcattttcatatccttgtagcagagctatcactcattttagctttgaggagaggtgggacatttccaagaggtctgactttctggatttattttactttacagaacctggacctgtagttcctccgattcttctggatgtgaagtcaagaatgatgttggtcacctggcagcatcctagaaaatccaatggggttattacccattataacatttatctacatggccgtctatacttgagaactcctggaaatgtcactaattgcacagtgatgcatttacacccatacactgcctataagtttcaggtagaagcctgcacttcaaaaggatgttccctttcaccagagtcccagactgtatggacactcccaggggcaccggaagggatcccaagtccagagctgttctctgatactccaacatctgtgattatatcttggcaaccccctacccaccccaatggcttggtggagaatttcacaattgagagaagagtcaaaggaaaggaagaagttactaccctggtgactctcccgaggagtcattccatgaggtttattgacaagacttctgctcttagcccatggacaaaatatgaatatcgggtactgatgagcactcttcatggaggcacaaacagcagtgcttgggtagaagttaccacaagaccctcacgacctgctggggtgcagccacctgtggtgacagtgctggaacccgatgcagtccaggtaagatactgactattctctctcctttgcagacttaggaatgtaccctggattgactctgtgttgaacagagccatctactgactaaacaaacgcatttgttgttttaggcattcactggagaaactgggttttggcctttggcccaaactatcttaaattcgatgtcagtttttcatttatccctgtatccccttaattatattgttgagatgcttccatttgcctcgcacacctgaaatattttgaatgccacaatgatgcttagcttaaccaccacgtcagatttaaatagatcagaaaatgagaagagatgggaaaataaggaggaatgaattagcatattaacaaaattttccattaccaatagtctggtattttttaataatcaaagaatcaaagtaatggggaaagaaataaaaatagcatattaacgggctatccagaaagtgttcaattattcacctcattctattgggaatgaactctagtggacaggataactaccattgttttggctggcatacaaacttcattcaagggaaattagtgtaaccaaacaggagggagttttgtagcttagaagcctcttttgtgtaaatacacacaggcttccatggattcagtcttgtactactgccaaaagcattggtacagtagcttgctcaccggagcacaaaacaaaggacatttgcataacagcaaagttcatctgctgaaattattacttggatctatgttgtgtgttctctctcccccaccaaaagcaaacactaggtgatgctaaacagtgtaaattgttggagaaatttaatttaacctacaaattaaaagctatttttaaaagtctttgttagttttaatatgaagctggtcaaagcaacacacatttttgatataaatatgtgtatagaattccattcattaaacactaatgggaaattaattttaagtacacgatatacgatgtttattgtatgaactgagcaatgtaaagaattgctcttgattcaaaataaaaacaaaaccaaaaacaaaacccaagcatagagttaataatcattccagaaatgactttttttttcaatcttgggggagttttgtaaaactttggtagcagtaccaatcactatgatgcaacaaaacaaacacagtctctttacaaaggcaacactacataatggacattgttctggattatttcgaataaaaatcttataactaggcgttactgattgtggccgatctgaaaaagagtaagtattttcaggccgggtgcggtggctcacgcctgtaatcccagtactttgggaggccgaggcaggcagatcatgaggtcaggagatcgagaccatcctggccaacacagtgaaaccccgtctctactaaaaatacaaaaaattagccaggcttggtggcgggcacctatagtcccagctactcgggaggctgaggcaggagaatggcgtgaacctgggaggcggagcttgcagtgagccgagattatgccactgcactccagcctgggcgacagagcgagactccatctcaaaagaaaaaaaaaataagtattttcagaggaggaactcagtgtacaattctgcttgattcagcatatataaacaataattaaaagtatcagcttgcctggctttttcttcacatttttaccctcttttgattttgtaatatcatccatgaattaaacaatatacatggcttgtcagcctgctagagaagtttagattagcgtggctagaaagctgaatctcataggcactcacctgaggccacaaggcattggtaaccccaagtcaggaatctcaatgtctctaagaaggtgtctgaaatatatgaacatggtacactagtaatattctaaaaattcacactttttattctcatcttataactaggaaataaaaagttatcaatagaatcagcaggaatattcaactgagtctagtatttaatgctatatactatttaaagagtattaagataacatatctgtccttcagtattattggctcacatgttcagaacgatcttaagactttaccgaagtggacgttctcgtgatatagcttagctggtaaacagaggtatatgacagctaaacaacgacttctctttgtaaaatatgagatttaaaagtccaaattgcaaatagaaaatattttatatgaaataacagaaggatagtcattaatgcattggttaagaaattaattcaactatttatcatagagggttgttccaggtattaggatggatgaaggaaattgacagtaatattaacagcagtaacaataataatttcagttctattgacatttacggaacatcagtacatgagtgaacatctttgtaagtgcctcttttaggcagtagggacacagaagagatcaagatgaagtccctaggctcatggcgattacattttagacagaatgcaaacaaataactatgtaatatacctggaagtaataaggacttgggggagaagaacaaattgagtgtagagaaatatggaatgccagctgatagggtgggggataatacaaggagcagagttggtatttcaccttagtgttactcattttgtgcaatgtggtttttttctccatacaatgccacctgtaagaattacagtccaatagggaaatcaagagagacaacacatacttaggctaactagaaaataaatgcaatgtaacatattagtaagtactaaaagaggtgatatgacttggtataaatatgagccttgagaaaggcaaattggagagcacagcagcatagatgaaataatatgcttaaaatcttatttgattacaagaaaaataaatatataatgtcaaagagttgtgtcacctgaataagtgaaagccatgcacttttatttaatatttaatcacctaagaaaatgtatttcattttataaggttggtaaaaatgctctaccaagacctaaaacagttcaatgaaactatagactaatttcatttatgagtacagattcaaaatttctaaataaaagattaccaaattgaattaagcagtatattaaaagaatgatatacaaggacaaattgatttcattttaaaaatgtaaggatggttcaacatcaaaaaatctatcaacatatgtcttacatcaaccaattaaagtagaaagcccatatggtttttttttatcaatagatgcagaaaaaaaggcatacaattaagaagttatttctaacaaaaagtcaaagtaaaatcagattaggaagaaggtacttaaatgggataaagtcaatgtataaactgctgtactgaagccttgaattgaggattgataagaaataacatgtataaataactaagttgcatgactatgatgcaccaaaaaaaagaaaaaaaaaacttcttttatgataacatcatgagcctgtaaaccttgatgcccctgtccactttttcacaggtgaagcagaataaaatagagtaatcctgcagctgtcagctcctcttatacagtagggtcctcactcagctcagacaggtgaagccaccagccttggcaggtgcgccacaaggaacagtgtcacccagaccacaaacatgtgtagcttccttccctctgctatgtacacttagggtcactcatttatgggtttgataataaagcaaagtaaaagaagttgagtcttaatcatcatcctcattgacttttaaagatgggccaatgtttgatgtctacttaaaataaaccacagacaaaaagtataaaacagaggaaataaaataataatgaaaatatattcactgagttcatgttatgttctagaaattgctttcatttaattcttactacaactgtgtcagatagatgctattgtcattcccattttacagacaggaaaactgagaatgagggattaagtaatctgcataagattacataaggagtaagagttggaattcacacccaggcaatagggttctggagcctatgttcttctctacttctttacactgcaacaaatggaaaaaaagtgcaatcttcctggatggaaggacttaactccataacaagacaatccttccaaagtcaacatataaactgaacatcattcaaatcagaatgccgatgttttttgtttgttttatttcaaactggataaaataattttttattttttattttactttaagttctgggatacatgtacagaacgtgcaggtttcttacataggtatacatgtgccatggtgatttgttgcacctatcaaaccctcatctaggttttaagccctgcatgcattagttatttgtcctaatgctctccctcccgttaccctccaccccttgacaggccccagtgtgtgatgttcccctccctgtgtccatgtgttctcattgttcaactcccacttacgagtgggaacatgtggtgtttggaacatgaggtgtttggttttctgttcctgtgttagtttactgagaatgatggcttcaaggatgaagctggataaaatgattttgaagtataaatagaagactaaatgattgaaaatattatagaaaattgtggaagaataatgaggtggtactttctgtagtatgtaaacttactttaaagccattgagttataataatatggtattggcatgaaaaagacaaatggtcattggaaccaactagagagtttaggtatagataacgagtatttgttgaaatgacttattgtaggtagaatctgcattttatttcattggtaaagaatggtttgctttaaaaaatgataccagcccgaccaactatcaatgtgtacggaaaaaacagatccctttatcatatcatattataaataaattcccataaattaaaaatgttaatgttaaaaaagtaaaaatcttagaaaaaaaggagaatttcatgtaatctaaatgtaggggagcactttctaaagaaaaaaagaaactcagtagcttaaaaaaaaaagatagctatatgtagctagaaacaatctgattgattttctaaggcataaacttcccccccacccaccaaaaaaagttaacatccaaaagatagatctggaaagtacatctgtaacacatactacagacaaatcaatttcaccttaatatgcataggccttctaataatttataatacaagatactttaatagaaaataatttaggtaagaggatatattaggttggtgcaaaagtaattacggtttttaccattaaaaataatgacaaaaaccacaattaatttttcattcatacctcacataaagtcaagggagtgaaaattaattaaagaaacaagtaatattagcaaaaacgaatatcagtaatttcaagagtttgtggaggcacagatcacggataatttcattgtttatgataaagtgaatttccccaactttttaagaaagtagtatatcaataatgattaaaattaaacatgcattttccttttggcatggcaatacttggtaatctttccaatatgaaataaacacaagagcacatattgcatacattttcaaattttatttttagcataaaataatgtcagtaggattaacaaataatttgttttcaaccatgaaaggaatattatgcaaccataaaaaataatagggtgtgtccataatcaattaagtctgaaaagcaagttccagcataagtggtagagaactttttttctgtgaaaagtttttaaaaaataaaagagaaagagagagagacctaggatatgcaggagtatatttgctttgcttgtacgagcatacaaaaagtatggaagaataaacttcagactattaagttttcacctgagtgaaataaaacagagccacaattaatgtttcttgtatttatatatttgtactctttctctgtctgattgaaaaaatacaaatagaatatttgaaattaaaaattaagattaatatttttaaaggaaaggaagacattgtgaaagacaactttatttcaacaaatatttattgcacatcttgttctgtatgaatttttcaggggagtccatcataagaggaattactacactgtacggagtcaaatattcccacatgatctttctttatggtacatttttatcttctattgacaaaatactcttagaattatgcaatcttatgtctacacacgatggcaaggattgtctcatcacattagacatgagggttccgaggcctggagatgttaaatgttttgcctaaagccacaccgctttgagacatttatcatctcttagtccattcttaacccatatatcaatctttataaatgctcttattcatgaagttcttcaaaatagtttgatggagttaaagaagtgaggaagttgcttactatgcttttgggtgttactcttttcaagcctgaagccaatcaactaacctgcatgtctaagtttctgcttaaaatggggaactttgaaggtgccatgattctttttagagagacttttcagggatgtaaaagagctgctgaaagtcaatcgttccttaaacacttaaccggcaatttagccgtcctattttctgaagacttacaataaacagaaaaaatggaaacctgaatcattaagaaccactcaaataaaagaagtcattgtgataggaaagccatctctgaaataaacattttatttccagtgcaaaactataattctatttaaaagttttaatgtaatattattgttttaaagaacacatttcttgcttattcaggccaataacatgttcttttgtctgaatttttagggatgcaacaatatttcataatctttcttatgtacaatggatatacaaaaggtcataggaaattaaacaaactgaaagttttaatctcatatattttgaccacatatacaataataaatgtggtcttaagcatagaaaagaatagaatacaatatttagttaactggctccttaaaattcttggacatgggcagggcgtggtggctcatgcccgtaatcccagtattttgggaggcaaaggcaggtggatcacctgaggtcaggagttcgagaccagcctggccaacatggcagaacccctctctactaaaactacaaaaattagccgggtgtggtagcacacgcgtatactcctagccactcagggggctgaagcaggagaatcgctcgaacccagaaggcagaggttgcagtgggctgaaatcgcaccgctgcactccaggctgggtgacagagtgagacgctgtcttaaaaaaaaagaaaaaacttgaacacattgattaattgattgattgattgattgagatggagtttcactcttgttgcccaggctggagttcaatggtgcaatctctgctcagtgcagcctccgcctccctggttcaagcaactctcctgcctcagcctcccaggtagctgggattacaggcacctgctaccacacccaggtgatttttggtatttttataccttatacaaacattaattcaagatggattaaagacttaaatgttagacctataaccataaaaaccctagaagaaaacctaggcaataccattcaggacataggcatgggcaaggactaagtattaatggtttaaagtgttgccaagctctgacctgaactctcaaagtattctggtctaagaggcaagaaagccgtattcttcagattagtcaggttgaatttagctgtgatagctcttctttttttcatttctgttacaaataccaggaagctctctgagtttgaccttgactcattttccgggtccacagacagcattgcacctccaaaacaaatagcgtcctatatctgtgctacaacctttgctagttttagggtgtttttaaaaatattccccacatccaggcaaatcctctatgtttataaggaacacatctaaaacttctcttcatcccagcctctcttcttagaactctccaaaaagtttttttaagattcacaatgatttcatcccctgtagtataatttggtagatattggcccattgttaattataaattaccaaagtaatcatcaagcaattgtccaactagcatgtggtgagagcccttttgtcaccaattattagtaagaatactctttaaaaaatctcaggtcatagtcttcctggatgaaaccttctccctttgatttaagatagaaaattatggtcagtccttctccattttaatttctatattgctcctctttggtttgcataggggtacaaatgtacatataaatatgtcaccttgtagaaacctgtctcttaaagtttcaaaataactgtatgctagggaaaaaaatataatctaacaaaacatgactctaattactaactgaactccacctctgtgcacatggtactaagtgaatgtagagtttatccctgctatgaagaagcttacaggctgggacatgagatatatatcctggcatttatataaagagcactagaaggtaccaataaaagagatgaaagaggataacatgtaaataaatgatttttgtcatggcctgtgcacattttttaggatctctttccccataagaacatgagtgtgttaccactatgctcctgtagagtttagccagaaaagaaaataaacttcagacattctagaattctactacaaaatgttgttctttcttctgatgctcaagtccacatgttagctaagcacaaacatctttggcttccctttttcaaagctttctatacattccttatccctgagaagaggatgtgctattaatgctttaattgctaagttatatataaataagattcaggaactcaattttgcatcttcggaaaatatgaataatgatttctctttcccttcctccaagaaaaagtgacttatttggcagtcacactaacagtgcaaagaaatgagttctgatgtttcatttagttgagttataaacatgaaaaccatcaaatcctatgcaaccctattgaagcatgtggatgtgtgaattttctccatgtgtttgctctgtgtccttcagaacacccacagtggcgatgaatcgctaaggtgtgtatcagtctgacagtcgtagaaagtggcaagactgaaagccaaacccaggaaacagcatttcatttagctcctggagtactgctaattgatctcaaacccttcattactgtctagtccaaaggcctcaggagaatgtagccatttagaaaatgacttaactgaaaacaagagcaaaattctaggcctcgtgaacttcaattgctctattcctgtatcgtcacactgattctaagtttatctttcatttcaggtcacttggaaacccccactcatccagaacggagacatacttagctatgagattcacatgcctgaccctcacatcactttaaccaatgtgacttccgcagtgttaagtcaaaaagttactcatctgattcctttcactaattattctgtcaccattgttgcttgctcagggggtaatgggtaccttggagggtgcacagagagtttacctacctatgttaccactcaccccaccgtacctcagaatgttggcccattgtctgtgattccactaagtgaatcatatgttgtgatttcttggcaaccaccatccaagccaaatggacctaatttgaggtaagagaaggtgactatgatttttatgttgctgtagtccttatctctctgagaagtagggaaatgaaggaggcttttattcctatatgaacatagaactaatttggcattgaatatcccctgactcataactttcatacactatcatactgtacacttcaacttattatggaaacatcaaagtttatcaatttgaagaactaaaaacccttgaaaccacaatcactattgtctaaggattcgctacataatccatcacttcattttcaacatatgcttttattatatgttaggcaaacctgatgtaggttctatatgatacatttgcacaaatgtacctcagaattctaaggctaacacagtaattctttggcatgttgttagcttatggaaacttgtgaggagtgtggtcagggagcccgatacgatgaaagaaaagagctgtgattcagaaatggttttgcaaccacccaaacttgatacttggccaagaatacaaagttgataatattatcatcgtttataaagtattgatagtcataggaaaccattaacttgataagctttgtgtatttctactttgtgcgaaactggcagtaaagatttggcacatctaacttagaagaaatctaaaatgctatcattctgggagataatagtaaaatgcgaatgtaactgattcttcaaaatattaaatatatggaatttggtccagaaaaaaaaacgttcatctgaaacaaaaccacgtaactgtaaacttaagatgttattctttatgcttccacgcatatatcacacgcacatgccacagaacagcctgagttttggtaatctcaatatgagttgagataatcctgatgttcctgcttgtcttttgctttagatatgagcttctgagacgtaaaatccagcagccacttgcatcaaatcccccagaagatttaaatcggtggcacaatatttattcaggaactcagtggctttatgaagataagggtcttagcaggtgagattacaaaaactataaaaacaaatgctggcatttagttctgggcatgttgaatagttcaaagtatctcagtgtcttcattgtgtgagcgtgttatcagttatgcaataaaacatgtttggttattatctgtggcattaatcacccagctgtaacagtcagcatgtttaatgttttccatcttaactgcatgcttaaaataagccttttgaagttgaacttgtagatgttcaagccttaacctattgcctttgtcacggctccatctagacataaaacgttatggaagaatttggaaatattgaacacatacaaaatggggaaaattcctgggcacttgtagaatgcttgctatttctagaaatggcttataaatgaattataatgacttataattgattgtaagttattgattcagtccgcaaaagaaaacattagtgaacaggattgggacttgaaagaattcaatctagagttcaaagacattcagtaaaggctaataggtgacagtagaaaagggtgctacatgggagagttaggagatctggttctgctttagcctgtgctggagaactagctttgtgactttaggccacaaagcttcactacttaaaaatcacttaacttctctgggcttcatttttgttgtccataaaatgaggtgattttatagaattaaatgacttctaaatcttcatgagttcaagcaatgtgattaaatttcagaaaacatgaacgttattttatgaaaactcctcgatcatatgtttcagtaacttttctatgtgggtcattatttttctagacccaccactgggtagctgtagtctgaaccctgtttaccattctagccttgtctcccatccctttcttaccaaggcctctgcattccagccacatttgtattgcattcagtacctccaacatacaacacttgctctttcagcttttccccatagttgccttttcctgttgcctgactagatcatctgccacgtcttagcctggaggtttcttcctctaggaggcctttcctgccaacactcttgctggtctgattcagctcctctgtaacatttccataggacatcccctaacatatcactattgtcattgtagtgtactggcctgactgcttgtctaaacaccacgttatattatcagatctaccataaggcaggggtgcggtcttcgtgactctgtcttcagttcctagcatggtgtctggcacataccagcacatagtgccctacacctgaatacttaaaaataggttagctcaatcaagaattaattcactgctctgtaccttaggaatattagctgtagtgttcttctctctggggaatggcaaaactaaggaaaattctcctgtcctcttaaaaagttgtggtgggaaaacatcctagttcttgtaagattctcagagagaggcatctcgtaaatctgatcaagcaacagaatgaactatatgaaactgccacttttataggtgaagattggtcaattactagcagatccatgttgcttatcctaaattataatgctcattatactattctcaactacttttaattcattatttacttaatttggcatccctatatgattatcacttcagtagaataaattcatttatttttgcttatttgtgcttactgtgtgctgaggcactgtgataaggaacaaaagataaatacatcttagcccttgacctcaaagaacttataatctagtggaggaacccttccccccgccccctccatagagagtgtgatataatatgtatttttatatattatatacattattaattatatataataatcaatatatattatatatttatatattgattattatatataattaataatatatataattaatatatatattaattgctgtcctcagagttatctacaaagtcaccaattctgcctaaagaaatcacttcaaatagtagcttcctgtgacctatgaactcttaagtgcttaaatataactatttcaaaaaataaatagaacttgactctttaacattactgaatctgagttttagccatgagctactcagcaaaaacaaagaataagtttccaaaagttaattttgtttctttatacaagaaatgaaaacttattaaataattaggaccaaggccatgaagttagttatgaatttttagtgattcctctaaggattcttaatgagaagttcaaatctaagatttcaggaaaaaataaagtgaatttccacaacttaaattgaaacatgaattgacataaacacacccatgacagctgcttccggaagggaagtgtgcagataacaaaattgtgttaaagggatattttgactagtttcataatgccaaatgtcatttttttccggtagtacttgcacagattttttttatttattaaaataacagctacaacttacattaagcttgtagaaaaaaaaaaagcatttcttcttaacattcagtgtaaatggcgtgagtctttataagaatctctttttctagccctctaccctttataagtccataaaaagctaggagtgcctttagcccaagggggagtgtcttgcaaatatgagagaaaaccaaaacttgatcccctggcgggcaggatatttttctctttaaaggaagtgattttgtttggttagatggtgccactggccaccttggcaacatccggggctccttgttcctgctggtcagctagtggtctgtcaaattgcagagggggatgaagctgagtgttcatcatgtgttggttcacccctgtgttactgttccttcatggcccttcctttgcctatatttgttttgctgatttatttgtttggccaggtatgttttcctgggtttttaattgaattctaatatctttgggaggattatgtaatttcctattctccccagattccaccatcccaatttccttcttaacttaacgtctgcataaataaaaggagcactgaagtgtttcttaccatcttgacttgaatatcaccatagttacatttagaatcagcttttaaatggcacttctcctgatataaaaagtaaaattaagattcactagacatctctttatgaatatatttgtgacagtaaatataagttgaagccaatttcctagttcaagtggtctattttggctaagtatgtgtttataacgcatagaaaagcaccaatttaatttaaaacatcattatatttggaacttcagatcattctagtagttattttttcttttatatctacatgtacaaaacagtctcaagtcaattatccagataatttaattctaacaaaaatactttttgctcttatgattatcttaggtaaggagtaatttttgtctaaattgcacagctagttgcctcattatcgaattttgctctgcctgtgtagacacgaattccgtataactacaggtttatactgcttgtcagtttctaacttttcttccttaataattccttgcaaagtgagcaagttatggttgttgggggaactataactttgggtttcctgacattttcatcacttagaaaatctggcgaacgtgctgttatcatctgaagctgccgaagtgagtcaggcagggtttaacaagagggcggcgacctccttcattttaagcatcaatctaccttcacaattttcagcacctaacaacactgccttggttcctaagtgatcagataaaactgctaagaatacaatgagcatgttctccttttcgttgtggatttaaagaagaacaagttataataaacaatagggttattttactattatagagaaaatattgactgtcagattataatttagatttataaattagctttcattaagtttatgaaggaatgtatgttctaattgctattccttttaattatttatacatttctcagagtatttttttttttttttgcaatgacaatttggatggagacctctatgtgattcctcgagaatccactaattgtattacatttaaattaaaacattcaaaattaacacattttcgtcttatttttcaaagaagggtaagacttaagatgtaaatgcttaagctaaatatatcataaattctaagtttaaatcttattgacatatattttcatatatatttttaaatctactaaaataaagatgtttcaagtcctaaaagaggatgccatttctgtgggggataatattcaaaagaacataacttttgttcctcttctttgtaatgagattaaatatgtatagatgacatctgcatctttgctagtatgaaagactgggtcagttccatgacacgtgtttctataatataaataatgtcagattgtagctattaagtgaagaagttaactttgtacatagaaagggcaagtgaaaggaaagcttctcccgtgactaccaagatgagatagatcctgttaatttattccttaatatgggaatgtgaataaaaattgagtctaagaatgaaagccaacttctgtcaacactagtatgccatctcatagccatgcacttaattcaaaaggagtaaacatgtctttcacattcaaattaaattggtcacagtgttttttcccattggatttttttttcaatgccttacatgccctacacgatgtccttttctgtgtcatcatattatgtgttacctccttgtattagcccattttgcaatgctctaaagaaacacctgagactggataatttataaagaaaagtttacttggctcatggttctgcaggctgtacaagaagcctggtgccagcgtcttcctctggtgaaggcttcagggagcttttacccgtggtggaaggtgaaaagggagcaggtatgtcacatggcaagagagggagcaagagggcgctgggaggaatgccatgctcttaaacaaccagctctcccctgagctaatattgtgagggctcactcactaccacagggatgacagcaagccattcataagggattcacccctatgatccaagcacatcccattagggcctacattcaacattggtgatcacatttcaacataagatttggaggggacaaatatccaaactatatcactcatgaaaaatgaacttctaaatccagaaggatgtgttttgtcacaggaggtttttttcccctagtgttttcttagaataaaaaagcagaaaaactactttcattggctgtatttctttctcatggtgatgacaaagtagaacaaagatggaaattactgcaaaattatcttaggtctgacaattctggtagtgtagatatagatagcaacagaaacataacagcttcaagtttcactcacaatctaaaatgtctcatattaaaaatattcaagtgtgatcaacattactcttcaatttttgaagcaaaaatcttcaatactatttttagaatcaacaaatagattttttaaagtgtctaccatcagctgaaaattttaatagctatagacttaagcaatggaaacaatattgcatttcatttttctttgtttgctattcccacaaaagatttgaagatgtaaggaaaagtatgatttatgagatttctcaaatccacacttgtgtgatggtgtactgaaaaatactttgggttgtggcagagatgaggaagagttagtggaagaagcaactaaataacctgcattttcagaagcgtgatttatattggtgacaatattaacacatgaattctgttaggacatcaataaagttgacacatttttaattctgatgaaaataaccccaggcattctgcagctgccctgaagaattttggtttcccacaatatatcagtcccttccaagatacaagccttcacatattttgccctggacaaatgtcttcactggataaaataccacttcttatcaaaacctgccccaaatgttacctcctccgtgaagacttcccagctggatatggttaaattagatgcttcatctgatgcgtgttcaaagaataaggaataaatgaataaattagatgttctcatttaaaaacatatttctgtaaaattttatatacattatggctccaggtggacagataacaattttattatttttaacacctggcatattggtaatatccaataaatattaaatgaatgaacaaatgaatgagtgaagtgatgtattaaatatgaaaaagcaatataatttgttttcaatatatttttaaaagcactttgctaagtttcagcagagatattctttctattggacaggtagatttttatctcactaacctaaaaaattatataagtgacctgaaatttttgagactgagtgcttaaataactatgaaacatctattcattcatttataaaattatctattcagtaaataaacaaattaaaactgcatcatttaaacataatctagttttctaattcattggagtaataacacctgaaccttgaaatgaatattgttccacaagtaagattttaacacatattattttttatgaggaaaattaccatagtcatgtctataccataataaagtttacaatttgctgtttggggagtggaggagggagagaccggaggatggtctcaagcaaatgggggaaaaactattgtaatagtccaagtattcctaaatggacccaaaaacaattggttttactggctacatcatagactcaatataagtattcacttactttgaatacttatattgcaaaagttttttcctacagagtttaaaatggacatttttcaagacatgcctagagaacacactttgtatttagagaagaaattgattgatacacataagttttgtcataagtatatgatgttaattgatctagcatttttgttttaaaatgtattcttttatcatttattaaatggaatgtcccatttaatatcaacaatcaacacgtaagtccatttgaaaaacagtatacatagagtgaatggaaaaccacttcaagccaactaatacattctttttttgatatgaagtggtgaaatgtgaatcaacatatatatgtagacaagccataggtatatattcttactaaatacagattggaattcagatgaaatgaaaacagtatattttagtatttaagaggattcaggatcttgtttcctcggccaggcgcggtgactcacgcctgtacagaatcccagcagtgggaggccgaggtgggtggatcatgaggtcagaagatcgagaccatcctggctaacacgatgaaaccccgtctctactaaaaaaaaaaaaaaaaaagctaggagtggtggctgacacctgtagtcccagttactctcaaggctgaggcaggagaatggcgtgaacccgggaggcggagtttgcagtgagctgagatcgcgccactgcactccagcctgggcacagagcgagactccgtctcaaaaaaataaataaataaaaaaaaaataaaaaataaaaaaaaaatcttgtttccttaaaaatttaacttaacaatgaaagttaaagtacaaaagacaaatgtacggcctcaaatgaaatatctactgatttctcaattaaatttttaaaaagtggaaatagtgtaatattggaaatgaataaaccctatgtccagctaccccattaactagttgtgcaaacttacacaaatccacttgtttctcagggtctcagggttttttgtttaatctgtatgatgtagcacacactttattatttgtagcagataaactctaaagccatctcttactctaaaattttagaaccaccttgaaaacaggcatgcaattgtgtgtatctatgtggcctgagttttgtagacgtaaattgtgtatttcgccataactaaattattgtgaaatctcttaaagtattataaaaactaaagccctatagaatttatttacaatcaaccattttagcgccacctgatattgttaattccacatgtaggaaagaaccacaaacatggtatcactttaaatccataaagattattaattgtataatagcatagacatgtggaagaaaaatttacatattataggagaggaggctaggtatccagactctagctacatttcttttaagtcattttatgaagtaaaatataattataagtattttacccagggagagagctaatgaagccaaggtcgctggttcaattcccttgtgagccattagcttcatttcattccattgtcataggcttgctaccctcttaaccccgactcatcatccttcatattcatactattggttgcaaaggaaatttggccagactgtttgaatgtgtaagcaaaaatctattccctctgctagaaaaataacgcaaagttcaagccttagtgatatgacatcatccaagtatggacagaacagattatcattatgattgttattattactattattattatcatcactattatgttggcagtatagcatcatggttaaaagagcaggctctgaaatcagactgcctatatttgaatctcagtcctcctacttattatctcaatgacttggacaagttatttatctctctgagccttgtttttcttattttcaaaataggtattataatagcaccttatagagttttgtgaggaatgaatgggttaacatctgtagaaaatgcctgacagctattaagtaactattattattttttagttgtctggattatgtggactattcagcacttgctaaaaagcatatgtattcattttccagggctgcagtaacaaaatatcacatactgggtggcttgaaacaacagaaatttattctctcacaggtctggatataagaagttgcaaaccagtttgtattctggaccagactcccttccaaagctctgtagaagaaccctttcttgcctcttccaacttctggtagccctaggaaatccttggcttgtgacagcataactccaatttctgtttctgtttttacatggccatcacctccctgtgtgtatccatgtgtctataaaatttctctctcttttttcttccaaagacatcagcattgaatttatggtgctgcctaatccagtatgacctcatcttaacttgattacatctgcaaaaaccctatcttccaataaggtcgtgttcacagggaccaggggcttgggcttgaaaatatctttttgaaagatacagttcaacccactacagcagacaaagcagaaataaaagaggcattaaacacctgagaagagatggtaaagcagggaggtgtagaagatctgatgcaagcacatatttaggagaaatagataaatagcctcaaaaagtcactaagttttacctgtaattacaatagagcaacacctttcaatgtgggtcaggcagaaacctgcaaacgtatcttcgggctatgaataagaaacaggatgagtcaagcagatttcttctacctaggtggcagtaaaatgctctgaggatcctgatataattttggtcaaattatttaacacaatcctgcaaatggcacctacccacccatgccacaccacctttgcatcgtcaaatcagagattgtgacatattgagacaaatactgtgggccttacactggagatgaggtatccttgatcatctaataaacccaaattaggtaatgatctgaggccagtgtttgccctgtgtcctggatgcctctgggatggtcgtgtgttgcactacatgtttaagcaagtatctcagtctaagctattgtccactcatagactgactgtgtctgtttatggcatttccttacacaggtagttctgaaccaagcaaaggaagcctgatggtcttctgcccaaaactggttaaaaaaaaatggtggctttactctatagtcaatttaataaatgacttggaaagtcctcctcatatcacatcagcatgtcagtttttgccttctgcaaagtaatattcggtttccactgtattgactcaagtaaatatgttcacactatggcaaaatacagctcactgtagcaaaactctcagcgggagaatgttgtacactttggtcacagttacaatttaatttaggggtttatctgtctgcagtgagattatgggaaagaagcataggtatcggaagaaaatgttgatgagggattctgatatttgaaaatggatgagtttccaaaaagaagagcataaaactctctggatcaaattcagatagaaagctggcaggttgcctgatttgtaattgcatcttgaattgagctgtaatcctcaccacttctgaaaacaataagaataagaaaatgataaaccacatttgttttcaatagcaatatttgttcagcattcctaataaaatatttccctgatgttttggtttatgctggcaagtcacaaaattaatgatatgtgttgtgtaaggagggaaaataaaataatgtattttctagggaggaaaagaaaacagtattttgtagaggggtggaaggaaatcctgtattttgtgaagaaaaaaagaaattatttgttagattttctgtaaagtagaaattcatatactttttttaacaaaacaacattttaggtttacaacctatgaatatatgctcttcgtacacaacagtgtgggttttacaccgagccgagaagtgactgtgacaacgttagctggtcttccagagagaggagccaatctcactgcgagtgtccttaaccacacagccatcgacgtgaggtgggctaaaccaagtaagtaagcttctcatacctgtgttaacactttgtgtatttttaaaagcatattctttctttactatgaacctcccccatgtacacatcattttgatagtgaagtgttactggtaaatttttaccaattgcagattgacagggctgtcattgaaaactttagaagggccatttttattagtacccaaataaattagaaatggacacattaaaactaaaaccctggggcccctgtgccattcttaagatgcaaactctctcctactttgacattgttcttgggcctcctgctctccctctgtcatttcctttgcatgaacaacgtaatttctatcataccaggcaattgtgatagacatgtccatgtattaattggatacaatgtactattgttcaccttccttcagagagctctgccctaatatcttgtaactcgtcgctcattagcaagaaccatttaattggattgcaataatggaacagattcttcccagtggatcatcttcagactggctatgggcagaattccagcttgatccagtaaaaggaagcctagacatcaccactggatccacttaaataatgcagggtcgaccctggacctgctgggaacacttttttaacaggcatttggaagagttcacagagtaatctaatctgttcctgcaacgttagaaaccacagtaactgaaatttcacagttacttggtcagtagggtagtattaacatgttaatttgttgtgatctgttaatttgtgtcaatccctgacgactatcaggaaaaaaaccctgaatctaccatgagaatatgtattaaaatcagtcttataggtataacttgagatctggcaaatagtttcatcaaaacttgtcagaataacaccaaatattgagaaatacctgatcaggaaagacccactcaaaacattttatttatgaaagaacactctgctcactggggtaatcatctattgatgatataaaaagatgaaaagtcactactggttgggcaatgtaaccatgtgattttggttacactggatcagccttgaatttggttacagcttaagaagagagatgctccatttaggacacctgagtgatatcaattgtgaattaaagccagaattgaggatatcaattgtgaattaaagccagaattgaggatatcaattataaattaaatcagtaggttaggtttatctgtgtttccacaaaataatccatctttacaaaagaaaactgtctttctctggtttttataaggctgcaggtttctaatgatctgtgacacttgtattgggatctcttaaaccattttaatggaataatataagttaattgatgcttatggctaccctctgaaacacctctgggaaaaatacaaagtttttatctggggatgtgttttaaggcatatttccattcatctccctcttgctctctactccacctcactaactgattcatcttaaaagcctactcataaaggtaggctctcccccctcatctgacatttgaatacttctgttaagatccggctggtgaatttccaccaatataggtcctttatgttataattgcattcctgaagtaactgtgcttataaaaactgacaaacctaatagatctgaagcagctcactgaagtttcattaccttggtaatctgaacctctgaccttcgggatgtaggtaatgcaatctgctgttatttccattcataccttggaaatttttcagataactatttgtgagcacaaaggttaactctcagaagagggtcagtcttgcgaaagcttgttgcattatcattttcttcttttgggcaacttgctatcttaagtaaattaactagtcgatcctctgtgaaaggtggcctattttttgcaattttaattttaaattgttgtcttgattggataggaaaaacatggcatacagtctaatatgctcaaaggcaacaaactatagattgaaaatactttgcagtggaaaatcatgttttaaatttataaatatttgcttattaaaaatcaccttccaatgtatatatatatattttaaagcatggtctttgtctattatgaccctccccatgtacacatcattttggtagcaaaatgtttctggtaaatttttatcaatcacagattgatatgtataagttattaaaaacttttgaagggccagttttaaacattagtatcacatacatgatatgtgagataaaagcgtccctgtgttacttcagttcatttttggaaggcagatgttgcaaattggcaacacagtggccatatttccttcctcctccagcttccatacactgttttgcccacagtatttgaaaaaataatatttgcaaacatttaagaattatacataaagataatttgaggattcacttgacaagtcaaatgatggggtgaaacaatacccacatttctggaaggaaactatcagctggaactggcttcccctttagacagatcatgccctaaaaatctgacccggtccccattttcctggtcccaatagacaggtgatgtttatccctgctttatatgataatacaaaatattttgccctaaacaaaatacaccaaagataaattatattgtaattttgaaaaatcacagtttttgtatttgaaaaatacctcacttaaattatttatacaatcctcagaaaagcacaatgagatagaaaccagcccatagtaacttaccaaaaattatagaaagtaccagttcccaaactcaaacttaggactcaggcatcaaattttctatttctcatgcgtttagacttaacagtcattaacactttaacaagaaggatttaaaaggatccttctcatcttgactgctcagtctaaaatagaaggcaaaataagaaaatgcctaccaaagggagtacagtggagagatagtgcctcctttgaagctgattcactaaggaagtcagttgtggccagaaaagagcagtaaaacactggagggagtgagagggcaatgctttgtaaaagaggaaatgaaaaatcatcaaaatattgtctactttactgtctgtcaagagctcaccccaaccttcagatgttcatatcttgtatcatataatcctcctggtcttgctctctccttcctctttttttccatcttccttctttctctatttccttttttaaaatgtttttgtagagacaggttctccctatgcttaggttagtctcgaattaatgggctcaagtgatcctctctccttggcctcctaaagtgctggaattacagccataagggaccatgcctggccatttgtctatttctcttcttctaccctctctctctctctctctttcttcctattttccttccttcctcacagatacatttatcactttctctgtcctgagcactcagtgaactctggaaaatgcataaagtatgagggtatcatcattaagagggcaagtttaaaaccacagaaaaagcatttgtctcatcctgatctcttaatcagaaactaccaggtttgatagctagaagtatatctgactttgcctgaatttatctgattaaggtggcaatatctgtaaataattccaaatctcatctcttctaaaaagcacctaccattgttgcctcaccttgttcctctgttctcttttccatcactttagttatcaaatagaagagaccacatctgacttttccattgtcttccttctcagtcacttgtgcacctgttgtaatctgtctctcttcacttgtactctacatggttttcttaaagtcattagttatcacctaatgacccatttcaaaactctcttctcaatgccatcctactgtgttcctcttgtatccagcactgtgaatgatcccttactgactataattcttccccaataatcattactcccctcttctcaccaactacttcttctcatccctaaagatgtttctcaaagttctttcctgagtcttcctatcatactcctgttctcttgttggtgattccatctatactcaaggtttcaaattcttctaattacaaaaatgacaaccgccaacattgtatgcagccatatgaataaatagttttaaaatagactttgggatcagggatacttaaatttgaatcccagttccaatatgttttggcactacgacctagaatttaacctgagttccagttttctaatcagaaatatgaagataataactgccctgaaatctgttaaggactaaatgaaataatatatgtttaacaattagtaatcacctagtatttgtaatacagagtattattctatttctaaaatgtgcatggtcctttcaataccattttatataatatataaaaggggaagccatgtctagtaaaagcttggaagttgattttgcaagactattcagataaaagcattttttttattattattatactttaagttctagggtacatctgcacaacgtgcaggtttgttacatatgtaaacatgtgccatgttggtgtgctgcacccattaactcgtcatttacattaggtatatctcctaatgctatccctccccactccccccaccccacgacaggccccggtgtgtgatgttccccttcctgtgtcctagtgttctcattgttcaattcccaactatgagtgagaacatgcggtgtttggttttttgtccttgctatagtttgctgagaatgatggtttccagcttcatccatgtccctacaaaggagataaaagcatttctacagtgagttgaagatgcataaagaatatatgttattttataattacctgacttggctaaaagatagaaatttaaaaatctagttaaaatgttgaaaacttagtctgggttccatggctcatgcctgtaatcccagcactttgggaggccgaggtgggcggataatgaggtcaggagatcgagaccatcctggccaacatggtgaaactccgtctctactaaaaatacaaaaattggccaggtgtggtggtgcatgcctgtagtcccagctagtcgggagactgaggcaggagactcgcttgtacccgggaggcggaggttgcagtgagccgagatcgtgccactgcactccagcctggtgacagagtgagactctgtctcaaaaaaaaaaaaaaaaaaaagcgaaaactactaactattgcatggcatccattctcctctttttcttttagtgatagccttgccccttatctagaaactgcatttactaacctcccttgcaattagtcatggccaggtgaaataccagtagtatgtgtttgtgtcaatagaaagtgaaagacaatctgcatctttttgggtattaaccagaaaacactgggtgtgtgcctacttgttctcttttagcccttcccctggactggaatgaggacatgatcatgttctcaggttcaactatgcagtcgtgtacaacacccaaagagatccaaaatccccataagagaaagttcctgggttcttaagtgaccacatggagcacagtctgttttgatcactttgaagctattacatgagatacaaattaacatggattttatttaaactattatattttggagattttaggtttcaccagcttcgctaactaactcattccctgtttgcccatatcaatttaccttaaaagtagaaattagctatcctgttttttaactaaatataaaatgatgaataattaatatatctattatactatctcctttaaatacagttttctctggcaggcccctgatagaagctggaacactatgagagactaaagtagctctggagtttccaaagtgcaggtgtttggttttgacagatgggtaaactagagacaagacaggagatatgctgctcggaaaactaaggaggctgacttgaaggattattgcccaagaagttaatctttccacttcatgtcagcagtagtaccctcaggcagagtaaagaattttctcaagagcagttttgacaagctcaaattttccaagagctgcttagttggtgacgcagagccctgcaccatagaacttggaaaattggactctaatttggagattctgcgagcaagatcaagacttccatcataaaatcagcttaataaggtccttccaggtttttacatttgagcaacattacctcccaaaatgagcctgctaatgtgagatgtctgaagaatttagtcctagacaaataaattaagagatctaataaatgaaatgatttactataattgatctgaatcagtacaacaaactttttttgtaaagtgtcaaatatgtataatgttagactttgaagcccatacagtctctgtcttaactcaaatttgccactggagcacataaacagcaataaggtgattctgatttttaaataagcatggccatgttccaataaaactttattttggacattgagatttgattttcatatattaggttggcacaaaagtaattgtggttttcgccattgaagtaatggcaaaaaccacaactactttgcgccaacctaataattctcacatgtcatgaaatactttttttcttttgtttttttcccccaatcaaataaatgtacaaaccattcttagcttgcagggggtgggccacactaggccaacaggccagatttagctcatggaacatagcttgctgacctctaatgtagatgttaaaaatctagaagacataattgacattgataattgtcttggtctgtttgtgttgttataacagaatacctgaggctgggaagtcaataaggaaaagagttttgcttagctcatgattctgcagactgtacaagaagcatggctgtagtatttacttggtttctggtgagggcttttgtgatgcattaaacatgacagagaaggtcaaaaggtgagtggacatgtgcaaagatgcaaaatccaagggatgcccggctttctaaaaacccactcttgagggaactaattcatttcttcaaaaactaacccagccttgccagagcaagacaccaagccattcatgagaatctggccccatgcaacaaacacctccaactaggcctcatcttccaaaactagtacactggaggtcacatgaggtttggtggtgatataaacccttgatccccctttgctgggaaccatggcaataatttaaggccatgtaagaagcacaatctacttgctgttgcaggataacttttaactagcccgtctgttatggactaaagccctaattctcagtgtagctgtatttggagacggggcctctaaagaaatacagtcatcccttggtatatgcaggcgattggttccaggactgccccctaagtacaccaaagctgtgcatactcaagtccagcagtcagccgtgcagaatccatgtatatgaaaagttggccttctacacgagttttgcatgggagaatactactttattttttttggagatggagtctcattctgtcactcaggctggagtgcagtggtgtgatctcggctcactgcaacctccacctcctgtgttcaagcaattctcctgcctcagcctcccaagtagctgggactacaggcacatcccaccacgcctggctgattttttgtatttttagtagagacggggtttcactgtgttagccaggaaggtctcaatctcctgacttcgtgatcctcccgcctcggccttccaaagtgctgggattacaggctagagccaccatgccagctgagaatactatattttcaattcttgtttggttgaaaaaagtccctttataaatggacccaagcagttcacacctgtgttattgtgttgttcaagggtcaaccgtaattaaggttaaatgagattataagagtgggacctcgatttcataagttagcacacaggctcgcttgctctttctctctgtctctcccccaaccccttctctccctttctccgatcacagaggaaaagcatgggaaaactcagcagctagaaagtagctctccaaaagccagggaaagagccctcagcagaaactaaatttgctggcgccttgatcacgaacctctagcctccagattgtgagaaataagtttctgttgttcaagccacccagcctttaatattttgttaaggcagcccgagcaaactaatacatatctaactactgttaaaattatttaggaattcattataaaggagaggagcctgttctatatttgagaatttgctccagctaagataaaatttctgaccaaggattggaggttgcaactaaaaataacatttaatagcaaagctcttatccaaaaaggttacaacctttttcagctcactgagattgtaatagtctgttctcacattgctataaagaaatatgcaagactgagtaatttataaaggaaaaaggtttaattgacccacagttctgcatggctggaaaggcctcaggaaacttacgatcatggcagaaggtgaagagacgacatgcgagataggtgagagagagaatgcacacataggaggaactgtcaaacacttatgaaaccatcagatcttgcgagaactcactatcatgagaacagcgtgggggaaaccacccccgtaatccaatcacctcccaccaggtcctgcccttgacacatgggtattatggagattacaatttaagatgagatttgggtggggacatgggacctaaccatatcagagattaacttgatattcccacaagtagggcaatacctgctcagataaatttatgtggtccacaaaatatgcatcatacataataggattagaatatctgagaaaatatatcccaatatacacatatttaacataatctcacaggaaatcccgatttctttctattgcatcaaatacaagcaagtacaagccttaactccatattgtataactgtaactcaaacattcacattgtagtttttaagttcacctagttgccacagaaacacttgaaagataacaaaatcctaagctccaacaaccatctgagtggatccccacttggccaaggggacaccagagcaaccttgaaaactgagttcttggctacagtgggatgggaagtcagacacccctccctggctatacaccattagggttacttccctaagtgctaagcagaaaccaccctttcaaaagattccaccactgatatcaaccaaccacctgatgctgcccctcttctactaactgatgagagacctctggccacagagttgtcatggccagtgtatggagaatctgcagtcagggtcttcatgtcctcttcttcactgcttgatgtcagagggctgaaaactccaccctcagattgtgctaatgctgccatttttgtacgtgggatgcaccaggggatgtaaaactcaattgcacatgtgcgtgtttctcctttcataaatactcatgactcttcctgaggcttattgaatatgtatattcagtcaccccactcagcataaattcctgttgctcctcccttgaagaatcttttctggcttctggcttaaggctaccatatgcttcccaggctgtctgaatggccatcctgcaggctgcaaccctttatgagaagtaaagctctccttttcaaatttatgaacctcttctgttgacacacttcaaactcaagaagtctcaaatgaaacaagtttcaaaatctcatcccataattccatgttttctatcttatttaatgggattcacccagaaactaaaaccaaaaatctaagctatagctgtatctcttccttatccctttttaatttgtttatttacttatttgtacacgaataagttctttagtggtgatttttcagattttggtgcacccatcacccaagcagtatacactgtacccaatggttagtcttgtatccgttgcctcccttccacccactcccccgagtgcccaaagtccattgtatcattcttatgcctttgcatccttacagtttagctctcacttatgagtgagaacatatgatgtttggtttttcattcctgagttacttcacttagaataatggtctccagttccatcaaggtttctgcaaatgccattattttgttcctttgaatggctgatacacacacacacacacacacacacacacacacacacacacacacaccaaatttttttatccactcattgattgatgggcgtttgggctggttccatgttttcacaattgtgaactgtgctgctataaacatgcatgtgtaagtatcttttcatataatgacttcttttcctcttggtagatacccaggagtaggattgatgaatcaaatggtaaatctacttttagttctttaaggaatctccacactatttttcatagtggttgtactagtttacgttcccaccaagtgtaaaaatgtgttctttgtatcacatctatgccaaggtctattattttttggttttttgattatggccattcttgcaggagtaagatggtaccatattgtggttttcatttgcatttccctgatcattagtgatgttgagtatttttcatatgttttttggccatttgcacgtttcttggccattcttcttttgagaattgtctattaatgtctttagcccactttttgacttgattgtttgtatttttcttgctaatttgtttgagttgcttgtagattctggatattagtcctttgtcagaagtaaagatttttaagactgtctcccactctgtgggttgtctatttactctgctggttatttcttttgctgtgcagaagctttttagtttaattaagttccaactatttatctttctttttgttgcatttgcttttaggttctttgtcacaaagtctttgcctaaactaatgtctagaaggatttttccaatgttatcttctagaatttttgtggtttcaggttttagatttaagtctttgttccatcttgagttgatttttgtacaaggtgagagatgaggatctagtttcattcttctacatgtggcttgcaaattatgccagcaccatttgttgaataggttgtcctttacccactttatgtttttgtttcttttgtcaaagatcagttggctgtaaatatttggctttatttctgagttctctattttgtttcattggtctatatgcctatttttataccagtaccatactgtttttgtgactatggccttttagtatagtttgaggtcaggtgatgtgttacctccagatttgtccttttagcatagtcttgctttggctatgtgagttcttttttgattacatatgaattttaggatttttttcaagttctgtgaagaatgatggtggtattttgatgggaattgcattgatgggaattgtgttgatggtaatttgatgggaattgcattgaatttgcagattgcttttggcagtatgatcattttcacaatattgattctacccatccatgtatatgggatttgttttcatttgtgtcatctatggtttctttcagcagcattttatagttttccttatagaggtctttcacctccttggttaggtagattcctaagtattttactttttatttttgcagttattgtaaaaggggttaagttattgatttgattctcagcttggtagctctttgtgtataacagtgctactgatttgtgtacattaattttgtatcccaaaactttgctgaatttatttaacagttttagagggtttttggatgactctttagtcatccaaatgtctctagggttttctgggtacacaatcatgtcatcagaaaacagcaacagttggacttcctctttagctatttggatgccctatatttttttctcttgtctgattgctttggctaggatttacatactattgatataggagttaaaaagaaattaggcagatagggatggtaagagagtcctcaataaggttttccttttaatggagagcagcagcccccaaattatctcttttctgacaaagagcagcctgttaaattgaactgcagacatagataagcaagctggaagcttgcatggatgaatgccagcagctgcaccaacagaaaaaggctacctgggggcaaggcatgttcaacatagtggctccatctgcccttttctttgtcgagcacatgtacagtaagaaacagacaacatggcactggccaggtagagaacccatctgcataacaaaagattaggatggggtgaccaggttattcatgcactatgtaaatggcacacacagtcccatcaatctttaggccctatgtaaatcaggcactgcctcctcaagccagtctataaagctccgtgcactttgccgtggactggaagacccatttgggagcccttctttctctgcagaagagagagctattctcttttctctttcttttgcctattaaacctccactctgaaacttactgtgtgcctgcatccttgatttccctggcatgagatgatgaaccatggatatttaccccagacaatgatgctgcttcagtatgttgaataaaagtggtgaaagtaggcatacttgtcttgttccagttctcagggggaatgcttttgatatggtttggctgtatccccacccaaatctcatcctgaattgtagctcccataatgcccacatgttgtgggagggacccagtgggagataattgaatcatagggtgggtctttcctatgctattctcatgatagtgaataagtctaatgagatctgatggttttataaaggggagtttccctgcacaaactctcttttcttgtctaccgccatgtaagatgtgcctttcaccttccaccatgattgtgaggcctcccaagccatgtggaactatgagcccagtaagcctttcttttgtaaattgcccaatctccagtatgtctttatcagcagcatgagaacagactaatacagtaagttggcaccagtaaagtggtatgctgctgaaaagatagccaaaaatgtggaaacaactttggaattgggtaacaggcagaggttggaacagtttggaggattcagaagaagacaggaaaatgtgggaaagtttggaactccctaaagatttgttgaatggctttgaccaaaatgctaataatgatgtggacaatgaaatccagtctgaggtggtctcagatggagatgaggaatttgttgggaactggaacaaaggtgactcttgttatgttttagcaaagagactggcagcattttgcccctgccctagagatttgtggaactatgaacttgagagagattatttagggtatctggcagaaaaaatttctaagtagcaaaacattcaagaggtgacttgggtgctgttaaaggcattcagttttataagggaagcagagcataaaagttcagaaaatttgcagcctgacaatgtgatagcaaagaaagtcccattttctgaaaagaaattcaagacagctgcagaaatttacataatttacctaagtaatgaggagccaaatgttaatccccaagacaatggggaaaatgtctccagggcatgtcagaggtcttcatgacagctgcgaccaacacaggcccagaggcctaggaggaaaaagtggtatcaagggccagacccagggttcccatgctgtgtgcagcctaaggacttggtgccctgtttctcagtggctccagccatggctgaaaggccccaatgtagagcttgggccacggcttcagagggtgcaacccccaagacctggcagcttccacatgatgttgagcctaccagtgcacagaagtcaagatttgaggtttgggaacctccacctagattttaaagtatgtatggaaacacctggatatccagatagaagtttgctgcaggggcaggcactcatggaaaacctatgttggggcagcacaaaagggaaaaggggtgggtgcctccacactgagtcctcattggggcactgcctagtgctactgtaagaagagggccactgtcctctagaccccagaatagtagatccaccaacagcttgcactgtgcacctggaaaagcacagacaatgccaacctgtgaaagcagccaggagggaagctgtaccctgtaaagccacaggtgcagagctgcccaagaccatgggaacccacctcttgcatcagcatgagctggatgtgagacatggattcaaaagagatcattttggagctttaagatttgacttccctgcttgattttggacttgcgttggggcctgtagcccttttgttttggccaatttctcccatttggaacagctgtatttacccaatgcctgtacccccattgtttctaggaagtaactaacttgcttttgattttacaagctcataggcagcagggacttgccttgtctcagatgagactttggtctgtggacttttcagttaatgctgaaatgagttaagactgtgggagactgtggggaaggcatgactggctttgaaatgtaaagacatgagatctgggagggaccagggcagcatgatatggtttggctgtgtccccacctaaatctcatcttgaattttagctcccagaattcccatgtgttatgggagggacccagtgggagataattgaatcatgggggcgggtcttttccatgctattcttgtgatagtgaataagtctgatgagatctgatggttttataaaggggagtttccctgcacaagctctcatttcttgtctgccaccatgtgagatgtgcctttcaccttctgccatgattgtgaggcatccccagccatgcggaactgtgagtccattaaacctctttcttttgtaaattgcccaatctcaggtatgtctctatcagcagcatgagaacagactaatacagctttccacttttccccattcagtatgttagctgtgggtttatcatagatgacttttattacattaaagtatgtcctttctatgcctattttgctgagggttttaattataaagggatgctggattttgtcaaaggctttctctgcattgattgagatgatcatgtgatttttgttttcaattctgtttatggggtgtatcacatttattgacttgcatatgttaaaccatccctgcatccctggtatgaaacctacttgatcatggtgaattgtctttttgatatgctgttggatttggttatctagtattttgttaaggatttctgcatctatgttcatcagggatattggtctgtagttttcttttttgtcatgtcctttcctgtttttggtattagaatgatattggcttcaaagaatgatgtaaggagtgtttcttctttctatatcttttggaatagtgtcaatatgattggtacccattcttctttgaacatctgatagaattccgctgtgaatctgtctggtcctggactttttttgttggtaacgttataattaccatttcaatctcactgcttgttattggtctgttcagagtttctattacttcctggtttaatctaggagagttgtatatttccaggagtttatctaggttttctagtttatttgcataaaggtgttcacagtagccttgaatgatcttttgtatttctgtggtatcagttgtaatgtctcctgttttatttctaattgagcttttttggatcttctctcttcttttcttggttaatcttcctacatggtctgtcaattttatttatcttttccaagaacaggtctttatttcatttatcttttgtattgttttggttgtttgtttcaattgcatttagttctgctttgattttggttatttcttttcttctgctgggtttgggtttagtttgtacttgtttctctagttccttgaggtgtgaccttagattgtctatttgtggtctttctgagtttttgatataggcatttaagactatgaactttcctcttaacactgcttttgttatatccaagaagttttgataggttgtatcactattatcattcagttcaaataatttttaattttcttcttgatttcattgttgacccaatgatcattcaggagcagattatttaatttccatgtattggcatcattttgagtgttcttattggagttgatttccaattttattccactgtgatctgaaagagtacttgatatgattttaattttcttaaatttgttgagactcattttgtggcttatcatatggactatcttggagaatgttccatgtgctgatgaatagaatgtatattctgcagttttggggtagaatgttttacaaatatctgttaagtctatttgttctagggtatactctaagtccattgtttctttgttgactttctgtcttgatgacctgtctagtactgtcagtggagtattgaagtcccctgctattattatgttgccctttttaaactcctatgtgtcaattaaagacaggctttttccatctagtgaatccaccattccccagggccttagagtcctaccttagatgggaaaactagaccctcatagacggccaattgctccttcacatctcagtccagatgcatggggcccagaaaatgtagttcaatgatttgacaagaagagaaaaatgttggtattagggagttctagaaatctttgccttcagattacagaagatagcttttatcttccgactatattttaaaatttaaatggtattaatgatattaatggttactaatgtctttctctgttttttcatgccattctattttatatgtaataaagaacttaatatgctgttacttttcttgcctttctcatctgctgttttcaatgttcagtttattattattgttaatattgttgttatgatataatttttttatgcaactattttctctaaatagcttcagtacttatcagcaattcttaaactttcccaatcttgagttctggatcttgattaatctttctgtcttctgaagaagattattggatagttttatcatgaaacttaaaaagatcaattaattagttttatgttctctaaatgtttggtgatataagaaagtatttctctcatctttgcacattctcttaaatttgcccaaataagaaagtatgtctgttgtttttacacataagtaaccatttaaatgtgtataaaattcttggattaaactatttcccctcaaaacttgttgaaattgttccattgtctttcaacatttgacattccacataagaagtttgaagcttatctgatttttttctcctttataaatgttcctaatttttggtttacctttaaaatgtttcaatattccatgatatgtctatgtttggatatattgtgattattttggagaaaactgtattagtctattcagtttgtagacataagtcattttgggtaaggtttattggggcatttcatatccataattatttattgcatttatttttaaggtaattagactttttctgttctcgatgtctataatttttactttcactgatgtccttgtcattttcctgttaattctttgatattgtgcatttttaactctgctcatttctgctttcaacgtacgttttaattctgccattgctttacatggttccttgctctcctttcttatttaaggcagacccctttacatctctgtctttgtggctgtctttttatgattttacaaacctacttcatagaggcttctttttcataaagtaatgtcccttttttatttttggtacaccatgcaaatattttataaaacctccatcccattgtcatagaagtaatatacacaaaacttctgccttggaaggttctagacaagatttcccttgtcttatgctaggaagaagccttgtaacttatgtttttctatttaaaaaaggagagatacattcagacccagcttttctcaatagacagggagggtgaaatttacttgcctcttcattcagctgtttccatgttaatagccttcctctctcagaggtaaaatcaaggtcatcagcctttaattttgtgctggtctattgaactgaagatgtatcttctgtttcttagatggttcactgacttaggaagagtacatcaaagtttaaagaccttatttgagcaatgaaaaagatgcttctatgcatgtactgctcccagaacttctcatgtgataaccaggaacatgtataaaattgtatgtgtttctacatttttctatgttttggacttccaagtgtaacatccacatgagtggagaaacaagtgttgaagcaaatgttggaaacagggagaataggccagaaatccggtacttgttacccagaagtgctgcctgtttctgttctcaagagcctccatatcatgcagtaagacataaacaatggaacggaatcaccatcttttcctgttgtcctaggttctgttctgtttcagagggactggcatacggtgcatggctaagaaaggacatttaatggggtctcatccagacattgacatgtgatctttgctcatcttgaacttgtgctagtggaaatatatttaatgtatctacataggtatattaattggaacttgatagtgcagataacaggcacatttaataacccaagtgaaattaatttatatacgtaagtgaagtttgaaagcatttcattaatattatatctttagggcttgactttataatcagcctgctcacttaacaaactaaaattcaacataaactacaaatctagtacactttgcattataccatagcagccacaaattaatgagtaataaataatgctgtgagacagtagaaaatgatgctagtaacagaagaaacgtttgcactcactacacccatggctttgctgtacttgacgaatattatcattcaggaaaatgttaagggattttaatagtcagttcctgccgatgatcaataatgacctcattattgcatgtgcttacatttttgtgacatcagaggaaagaaacactgcaaaacccagaattttccaaattaattgctaaaggtcttccaatacaaactcttccaactacactggcacatcatacccttttaactatttctagagctaaagtgaaagcagtagtgtatttaggaaaaacaaaaagaaaaacctagtattcagtttttatgcaaaatcaccaagactttaatgtaaaggggtcctttaaagaaacatactattctcaaagctatattactttatatggccatatgctgggatctcacatataagtgaaattggacttcaatagccataaggagaaatgccactttttcctcccaatccttggactaatgctgtttaactttttttctttttttttttttcctgagacatggtctcattctgttgtccagcctggagtacagtggcacgatctcagctcaccacaacctctgcctcctgagctcaagccatcctactgcctcagcttcctgagtagctgggactacaggtgtgtgccatcacacctggttagtttttgtgtttcatgtagagatggggtattgccacgtttcccaggctggtctcgaactcctgagctcaagtgatctcagcctcataaagtactaggattacaggtgtcagccactgtgcccagcctgagcaatttttgatgcataatttgacatgaaatttcagaaggcttgtaagccaacactccacccccatcctaacaaactaaggtaatcgtttctgcttaaaagtctctgaaaataatactgatgtaagtagagcagcataatacttcctacctaagaaaatatggctgttttcatgttctcttgttaaagaatcattgtgggcagataatgagaagcagagcctaaggaaaagaatggataaattgggaggaagaggagaaaaaataatagactggtctttgaaaggataagggttgaagaattgatgagttatatttgcaagacagttagtgattgattttggtatcttttaaaggcttctctacattatagaaacacattgaactagaagagaaggatgagagccctgataaaaatttaagtattatcctgagccagtccttaaggggagcatgctatgtagccctgctacattgacaatgtatataaaaggatatctttctaagcatccttctaggtatcagttagcgaatgttgttagcaagttaaaaaaatgtctctaggatctgtgtcaggaaatgctcttatttgtattagcctagtcttctctctaagattatgttacttatgagcagaagttgttctatgtactgtatactttcattttcatcttagtttcctttcataagtgttatatcaaagttctgatgattcattgaataattataagtagcaaaattaaaatatttaaaggaaattaaaaagatgagacttttataagactcatattcctacataagactgcaattaattatgagattgggaaaaaacgcaaattattaaaaaataaaaactgaccaggtgcagttgttcatacctctaatcccaacagtctgggaggctgaggtgggtgaatcacttgaggccagaagtttgaggccatcctgggaaacatagcaagaccctgtgtctacaaaacactgataaaaattaactagtgtgatggcctgagcctgtagtcccagctacttggaaggctgaaacaggaggatcgcttgagcccaagacatcaaggctgcagtgagccaagattacactactgcactccagcctgagtgacagagcgagactctgtctcaaaaataaataaataaaataaaaactatcaccaccagcaccaccaaaaaggagatctcataagctttttttaacatttccaaaacaaaggctctctaaacttctttttttctcattctagaaagctaatgatagaattttttttttcccctgaaagcctcagctacattcaccatgtcctgcatttattgttgacagctgttcaagacctacaaggtgaagttgaatattacacacttttttggagttctgctacctcaaacgactctctaaaaatcttgccagatgtaaactctcatgtcattggccacctaaagccaaacacagagtattggatctttatctctgtcttcaatggagtccacagcatcaacagtgcaggacttcatgcaaccacttgcgatgggggtgagtccagattctaaaggatatttgcctcagagatgcgaatgaaattgattgattcttgccggggttgagatcagtcatccctccattataaaatttccggtgtgggagggaagggggtggaggctaaaatgcttaagtgctcactgtcatcagtagcagatcaataagcagtcccattgagacagaagcacaagctctaataatgagatattagcccagtttgttcctgttcttttcagtgtatacttattttagaactgagttcacatcaataaatggtgacatttagaaactttttttttaagatttgccctcagaagcagtacgtttttcaaaacgacagccaaacacagtgagagccctccctgagtcaccagaaatggtaggtggaagttcagccactgagaaaaattgcctgtgactcatttctaagccagttagcaagggggaggaagcaagggaagcaacttgtgaatctgaaatgtgtttggaatggtctttctaatcttttttggctttataaagtctcattataaacattataatatcattacctcccaagcaagtgttccaggtcattagcagagctctttaagtgtggaacccatttccctttgtggtgccaaaggtcggcaccttttgtttataaaatagggtagatcacaaggacaattcttcaactagttaagatgggttcttatgataaaaataggtctttgcatagttatttctgacatgcttgaataattatgcaatttaacgctaagcaagatttttttcttatgttagatttcatcattacctatggtaatcaacattcaaaatcatttacataatgacaatattgcattattgcttcatattgcttgagttacaagctagtaacatcaaatgatttttcacgttccaccagcctcattgtatttgagttttattttttgctcaaggagcaaattttatttccttccctccctcccctgcaccttggaggtatagagtgaaaggatggaaaaaagacaaaaaatagataagtgttagtggtgcagatgggtgaataatttatcatcatatcccactggtcacatagtattgaagattagcactatgctggtggtataaagcattttaccaccaattcttatggtttctaactgagagtataataagccaatttacagaggactacagactgtgataacttcatcagcgaaaagcagataagcgaggaaccctttgctaaacctaaatactaatctgcatttagcttaacatgtgctttttcagagacagctggagtttattcagtttcttcctttaattctagagcctcagggcatgcttcctccagaggttgtcatcatcaacagtacagctgtacgtgtcatctggacatctccttcaaacccaaatggtgttgtcactgagtattctatctatgtaaataataagctctacaagactggaatgaatgtgcctgggtcgtttattctgagagacctgtctcccttcactatctatgacattcaggttagaacattgttttttgatggttaggcttatggatatgttaaataaaacatgccaggctatgtcttcaagtggatatcttctgtcttggttacagattatttctttggtggggaagggaaaagagagaagggaaattgatcagaattaaatctgtgtgctgtaggcaaacatgtgagtctctggagagaagataatgataatatggaaaacgatggtgatgaggatggtgatgaaattctcactggcaaaataaagctaatcatgtattctaaataaatcttgttgagcagcttaccttttcccaggatcttttactgaaatcaaaatcagaatcagtttgtaaatgtggagatgtttttttctcttcccatttctcctatttactaatttaatatctccagagaagttatgaaacttcacttggtgtcaatttcctcttttgtaagcgcaatggactagatgtcttaaaacattctagccacctctagcattctgtgattctgaatgcaacaggaagacatatataaaaaatatagcagacaaaaaatattaaaaggttttatctgaaggtgaaagaaatatatttattcatcactcaaaaaatgttcaatgttctccgcatatgtgagagcaattgtggttaaaattttttgcccttggacttctttgagaatcttatgaagtcagtgtactctgccttagaaaaatatttatgcacttgtatgacaaaatttaacacataatttcagaaagtgcactgatcacttgaagtcaaattcatagacttcttcaggggctactggccttaaaagtagaaaaagtatagggaatactaaggcatataaaacaaggaacttatcttcacggaattggaaatcttgttggagtaccaagccataaaagataacaaggctaaatgtgcaaatgagtgataaaaaaaaatcagagtatttcagaaaccccacatttagagaaagcttgcaatttacaaaattttttaataaactatgctacttctaaaattcataagagcttcgtaagataattttcagaagatattaagcacagaaattttatatgaccacagaaactttttactggttctatccatttaatagtactacctcattcaggtttccatctccttttcctgacatttgaggttaagacatataatcatctggctacaaccaacactttagtctcccctactctgactcatagacctagcttcctaagaaaaccaaataaaaatatctttgaataaagaagaaaggtacattaattatttttctttttttttcatttaaatgtattttattttaagttcctgtatacgtgttcaggacatgtaggtttgttacctaggtaaacgtatgccatggtggtttgctgcacctaacaacccatctaccaggtatttacctgtacatgtattattagctatttattctgatgatctccctcccctgatgcccccccaacaggccccagtgtgtgttgttcccctcgctgtgtccatgtgttctcactgtacagctcctacttataagtgagaacatgtgatgtttgtttttctgttcctgtgttagtttgctgaggataaaatggcttccagctccatctatgtccctgtaaaggacatgatctcattcctttttatggctgcatggtattccatggtgtacatgtaccacattttctttatccagtctataattgatggacgtttgggttgattccatgtcattgctattgttaatagtgctgcaatgaacatatatgtgcttgtatctttataatagaatgatttatatttctttgggtatatacccagtaatgggatggctgggtctaattgtgtttctggtcctaggtctttgaggacccaccacactgtctttcacaatggttgaactaatttacattcccaccaacagtgtaaaagcccttctatttctccacagcttcaccagcatctgttgttacttgacttttcaataatcaccattctgactggcatgaaatggtatctcactgtggttttgatgtgcatttctgtaatgatcagttatgttgagctccaggtgcccaccaccacaccaggttattcttttgtgtatattttcagtagagacagggtttcaccatgttgaccaggctggtatcaaactcctgacctcaggtgatccacctgcctaagcttcccacagtgctgggattacaggtgtgagccactgcacccagccaagtatctactttttgaataatccctttatatgtcccttttacaaagaaataataatttcatttttattcagttttacctctttttaatataaatatagtaagctttatatgtttgttggccgcataaattcttctttggagacgtgtctgttcatgtcctttgcccattttttttgatggggttgttttttcttgcaaatttgtttaagtttcttatagattctagatattaaacctttgtcagatggatagattgcaaaaattttctcccattctgtaggttgcctgttcactctgaggatagtttctgttgctatgcagaagctctttagtttaattagatcccatttgtcaatttttgcttttgttgcaattgtttttgatgtttttgtcatgaaatgtttgcctgtgcctatgtcctgaatggtattgcctgggttttcttctaggatttttatagttttgggttttacatttaagtctttaatccatcttgagttactttttgtataagatgtaaggaagggatccagtttcaattttctgcatatggctagccagtttttccagtaccatttattaaatagggaatcctttccccactgcttgtttttgtcaggtttgtcgaagatcagatagtggtaaatgtgcagtcttatttctgagatctctattccgttccattggtccatgtgtctgtttttgtaccagtaccatgctgttttggttactgtagccttgtagtatagcctaaagtcaggtagtgtgatgcctccacctttgttctttttgcttatgattgtcttggctatacaggctcttttttggttccatatgaactttaaagtagttttttctaattttgtgaagaatgtcattggtagtttaatgggaatatcattgaatctattaattactttgagcaatatggccattttcatgatatttattcttcctatccatgagcatggaatgtttttccatttgtgtcctctctgattttcttaagcagtggtttgttttcattgcacaccatgattcccatagcctacctgagttgtcttagcatggaatatgtggactgatgtttatgttcatgattcttatggtgagtccatgtatgcaggtagaccataggccaaattatgaaatagaaatcatgctccaaataaattagaaatatagctatataaaaaaggctaacacaggaaggtgatggaggatttgccgtattgtcttcttttgaccagtgttcgggaaagctgagttttcaaaggcaccttattcatttgctttaccaagactcgaaacacacaacctagaagtgagaacactgtgtgctgtgcatgcatgtgcagctcagctttctgactctggatcaagagttaacgtttaaaagtgtttaaggcctattctatggaaaaggctttatttataccactactggtttgagtcaggtataaataactcaagccagtaggtataaagcctcctcttctggtagcctgaggagagtggaaacagatgaaaatacaaaagatcaaagtagaatccaataatagaattttgttattagtgcctaagatattcttattactgattactatattttttgtgaagctttttgcagtccaggaatactgtacttgatatagctgttgcatttctggaaatttgaacatcaaatttcagtgattttcattacgatgtcaaaggtgatttagtttcatttaaaataagcatttgattggaatgcctaatactttagaattaaggctctctatgctaaccccatctgtaaaatagctattgattttaaagcacataacacactcaagtatctacttttttttttttttttttttttttttttttttgagacagagtctcactcttctcacccaggttggagtgcattggcacgatctcggctcactgcaacctctgcctcctggaatcaagagattctcgtgcctcagcctcccaagtacctaggattccaggtgcccaccaccacaccaggttattcttttgtgtgtattttcagtagagacagggtttcaccatgttgaccaggctggtatcaaactcctgacctcaggtgatccgcctgcctaagcttcccacagtgctggaattacaggtgtaagccactgcacctagccaagtatctactttttgaataatccctttatatgtcccttttacaaagaaataataatttcatttttattcagttttacctctttttagtataaatacagtaagctttatatttgtgtttcattcacatgttatacaatatcgttttagcactagaaataggtcccaaaatggagactgggaatgttaacattagtaagaataaaaacatattggcacatttctctaacatttgaggttaaaacatatataatcatctggctaccagcagtagtcattggtcattttcctttgaccaatgaatcaaaagaaatgttttctggagaaacatttgaatatacctaagtagtttagagcttaaagttatgtttaacatttagatgagaagccagtagggtacagtggagaacaactcagatatcccaaatcttaccagcttgacaatattccctggcttctctgcaaatttgtttaaatggagttatgaggaatcaatacgattatttgtgcatatatccattataatatttggcacatattagatacataataaattcagttgaattgattctgggttatctcattatgtatcacagaatcaaatttttccaatatgtataaagttcattttcattaattatattacagcattatattttaagttcatctgcctttatttcagatttaattggacatgctcagaatgtaggcccttgatagtgtttaaatatccactattaatacctcaaaagactatatggcatcaataagtaacacaactcatacagcattatgaacatatgcctcaactaacatttaggtaccctatgaataaaatagcatatctagtaaatacaagaatcccatttgcctttcctcaaccaccaaaggaacagagaactgtttcacataaaagctcggaattaatgtttaagattcatcagtacctagcttgccttctctatttatatattagatgcttaaagtaaattagcactgtaaaaagtacagtttctctttggtttatcctttaattgagagcagaatgatatcgctttgcagatgttcccaatcttttgcatattcatttctctctcctccctcttggttaacgtgttccttttgtgtgactaatgcttgatgaaccccatttctaatcttcagttattccaccctcctcggtttttattcagattaggtggcagaattaaagggatgaatgatgattttctgctgtgattaaggtaaaaatacaattgcatctggaacaaatggatataaaatacctcagccatattggaaggcttctctaggcctcatttttcctccattagacattagcatttaggctatttgttttacagtgtcaagacttccagaagataccatcattacactacttagttatagatttagagaacagtgagcagtgataacctgttatgcttgcaaactgtcacttgggcatcttccattccttgactatgctcttcagtagattaatgtatctttctctttgtgaatagttgcaaccagagagtaaacatcatcattcccattactaaatcaattatcttgatcccaattccgtaccttcctctgagctcattcctttggagtcagttaacatcaaaaatgaatattgattaaacctcaagaggctatagagaaatacaagagattcatgtgaaatgagggaaggtgggattcagactattgttagtaagtatttcaaaaatggttgcatttattttttctaaactaatgtttgcaggttgaagtctgcacaatatatgcctgcgtgaaaagcaatggaacccaaattaccactgtggaagacactccaagtgatataccaacacccacaattcgtggcatcacttcaaggtacaaaattttgtgtcagttaaatctaaggaactctgatcagaagaaatgaaaataaaaatcaaaggtatcctctcagccatgacaatctcatttaatgggttattataagtatgtgtgtaaatcaaatttttgatattatttcacagatattaatcttcactggacatccaatggcatttaatctttaatttccctgattgcccagcctcagatttcttatttagtaacctgtaagcaaatacttgaaatacatgtctccttatttgaatgtgtcctttagtgaatccttttgcggagcataatacaagcttaattgtaatgactaccttctaacttaatctttttgaaaaaaaattgatttatatacatcagagtgccctaaagctagaaatctgtaaaattagtagggcagataatgtttagataagcattaccaattttgtcagcttcttggtagaatcactttatttttctttattcttttgttgctgagaaatgaccatagtttgaaagcgagtctctttataattcataattagtaacaacaacaataataataatatttggtattgtttccaaagctgaaaataagatggtaaattgttcatccgtttgtatcaagttgaggctgggaaaagaaatcttagtgctttcacattatactttttgcttaagccaaatgaatcacccttctcttacatgtgcaaacaacacacacacacacacagacacatacacacactgaaataataagtctattattaatgtttcaattctgaaggatttctctatgacatgttgaaatttctggatcttaaatcagttcaaaaaattagtactggttttggcaaccaatggttaaaataattagaaaaattcaactaacctgactgttagctgttcgtggcaataatcatatcttgtctgcttgagtatatcttctatcaaacacatgatagatactgatctaatttttggcatactaattagtttataatccccccagcagatatcccccaacctattcacagtattatctactatgcagggaggaaatagtcatattaaatgggcgttagagacctttattctttagcaaacacatctgtggctataataatatagaaggcaaggtggggcgtggtggctcacgcctgtaatcccagcactttgggaggccgaggcgggcggatcacaagctcaggagatcgagaccatcctggctaacatggtgaaaccctgtctctactaaaaatacaaaaaattagcagggcgtggtggggggcacctgtagtcccagctactcgggaggctgaggcaggagcatggcgtgaacctgggaggcggaacttggagtgagccgagatcacgccactgcactccagcctgggcgacagagtgatactctgtctcaaaaaaaaatatatatatatatatatatatattatatatatatatataatatatattatatatatataatatatattatatatataatatatattatatatatatatataatatatatacacacacacatagaaggcaaaagtaatacaaaagagcataagacatgattctaaatttgcaaagttccagtccactggggaagatactcccctaaataaatgtttatagaacaatgtaaaaaacactataataagaggtttagatgtgcaagaacataaagagaaaaatagcaaactttacccagaattatcagtgaaggcatcatggaagatgtgacctttgacttcagtcttgaaaagctcaaggaagaattatagttaggtgggtggatgttttcaaattcttgtctgctggcatccccatgactcaagcccatgtgaatgacgtaacagaatatgcctcatagtacatatttatttataactaaaaataacgtctaagctttataagaaatggaacaaatgtgactgtgtctctaggttttttttcctttaagaagattattgcacataataacagaggacaaatatttttagttgctattaaaaattgcttgtatccaaatacattaaattgatgacagaaacattaaaaagagtattatacaacaagaacaaggaaagtgagagaggagacaacaacagaaaagagattgcaacacaattttgtaagcaatatttgtcagaaagaagcaaatgatttaatacagtggagaaatttacaaccaaaatattggttgacaaaagacaataatgacaggaaacaaactgttttttccacagagaactggagaggctgagcacttagaagttttaaggatgtaaagaggaggagagagggtagggtttaaagctgaaatcatggggtgagacacaactgttaacaaataagtgtttggaatcccaggtctcttgcatctttgctgtgcatccaggggtctatttctcttcctccacatgacaaagtccaccgaccaggagattagacatttattctctggagaaactgagggctactaggcagaggggagctgagatgagacacagaagtaaaaacagtgataaagtgagactacaacctgaatggtgggctttttggctaagtttcccagttctgccctcaaaagcaagtagacaagtcataaacacctccagataggaaactgaacatagttttctagaaaaaaaagaatgatctcaaaaaaaatacctccagataatagcatatagggatccctaacagtaaaaacaacttgtcctctggtcacccagtagggaagtatgccaatcaacaaggctcacctaactataaagcttttagtcagctttttttttttttttttttttttttggtgcatcactcttaaagataaaaaggggaccaaaataaacaaaagacatgatacaatagattcagagataatgcaggtgaggaaaaaaaattatagcctcagacagataaaagaaaattctctaaccataaaacaaaaccagcatacttaaaaaaataaataaataaccaacgaggagaaaacttcatggaaattaaaagggtgaaaagctgaattgaaacttttgaagaaagttcaagggaatgtctctgaaaatgcaatgaaacacaaagatttaaaagagagagagacaaagaaaaaacaatagagagtatccaggaagtctaatatttgaataataagagcttcaaaagagaatcaaaggaaaagagggagaaaatttaaaaaaaaaaaagacaagaaagtatcccagaaccaatgtactactgtgcagatcaaaagattccctggataccaacaatatgactaaaaagtgattacatataaagggatattatcaggaaattgcagagtaccatgtttaaaaagcacatccaaaaagctgccaggaagaacagacactaccacaatcaggatgtgaagcagcatcatgatgtcggtctccattattgctaacccctcttctacccttcctaaaactaagcaaacactgccatgttttgttatgtataattctgccttttccatattgtcatgtaaatggatcacataatatgtagccattcaaatggcttcttttagttagcataatgcatttaagatttgtccatcttattatatacatactagcagttgtatacatactagtagttgtcagtttttgttgctgagtaagattccattatatgaaagttctacagtttgtgcacagtttggataattttcagttctccgtgaccacgattaaagttgctgtaaaacatctatatacaggtttttgtgtgaagatatattttcatttcatgtgggtaaatacccaggagttggattgctgagtcataaactgccagactgatttacaaagtgactgtaacatctttcattcctactagcattgtatgagagttcaagttgctctacatttttgctagaacatgagatactatgaggtgttttcctcttattttttaaatagtcattttaatagatgtttgtggtgtgttattatggtcttaaattacattttccctaatgactaatgatactgataagctttgcaattgctttttgcatgcactttggcatttgtttactctgggaaatggtatctccaaatcttttgcaaatttcttaattagattctttgttttcttattttttgagttttgaaaattttttaaatatattttggatttgagtttttgtcacatatgtgatttacagatatttcttctctaccttatgatttgttttcaattatcttatttgtgtgtttttaagagaaagagttttaactttccaagagagttagatttgttactttttccttgacagtttgtgcatctggtattttatctaagaactttttgcctgagttaaggtcacagagactttctcttgtctatttcctagaacatttgtatgtttacatgttgaatttatgtctatgattggttttgtgttaatttttgtatacactgaggcatgagtcaaggttaattttttttggcatgtaagtatttaatagtatcaacaaaatttttggaaagattatcttttctttattgaatatttttagatttttgtcaaaaatcaatttaaacacgttttgtaggccatttttggactctcttttatgttcaatttatcaatatgtatatctataccaatatcgcacaatcttgattactacagctctatagtaagctgtcaaatcacattgtatgagtcctccaactttgacctttataaaaatcattttggcctttctcactactttgcctgtccatataaatttcagaaacaggtcattgatatctacaaaacatgtgattttgattagaactgcattgaatttgtggatcaattggtagagaattgacatcttaacaatatcaaatgttctgattcaagaacacactcttgctcatttatttgcatcttctttcctttattttatcagtgttttatataatccagtatgcaaatactgcacatattttattaagtttatacctaattacttatttggggggtgctattattattgtttctttaaaacaaattcaaatccaattgttgctagtgtgtagaaacacaattaattttggaatagtgagcttacatccagcaaacttgctaaactccttgtaagtcttaagagcttttttgtaattccctagtctatatagatcttctacaaagagaaactgtttatttttttcatttccaatcagtatgtcttttatttctttttcctgccttattgcactggatagtttaataacgtgataagagcatatccttgacttgttcccaatctttgaaagaaaactttcagtcttttacccttagatgtgatgttacgtatgaaatttttggccatgccttttatcacgttgaagaacttactttttatttttaatttgctgacaattttcattataaatggacatggaaatttgtcacatgcttttttgacattttaaatttgtactatgatcgattatatttactgattttaaattattgaactagtttgtattcgctggataaccagaacttcgttgtgacatattttcttcttcatatattgggggatgcaatatactattatcttatagaaaatgttcatctgtgttcataaaatatattggactgtgtttgattttcttgtaatacctttgcctggattgggtatcatggtaatttctggtctcatactaacttgggaagcatttccttcttttctattttgtggaagagattgtacaaaagtgttattatttcttaaatcttggtaaaattcaccagtgaaacccatatttgcctggagtttttctttgatggaaggttttttaacttggaattcaattcccttaataatgtatgatatttggcaatttattctccagtgagtttagtcatcttgtgggtgcagaaaataggttaatttaatcaaatttgtcaaatttattagcaggaagttgtttgtagtatgtttgtactacaaacaacaatttgttgcaattgattttattctttcatttctgatattggtagtaagtgcccccgtttttctgttcagcctagagttttatcaattttgtagatcttttcaaagaaccatttttggctttatttattttctatatcatctacattgttttctattttccatttcagtgatttctgctctctattgttttcttccctcttgccttgctattgcttctctagtttcttaaagatgaaaactttcattattgatttgagacctttcttcttttctctcagtcctgcttcggtatgaagctcacaaattttgaaatgttgcattgcacttcatttattcaaaatatattttaatttctcttgagacttctttaacccatggattatttacaagggtattgtttaatttccaagtatttggggatttttcagataagtttctatctgagtttccagtttaattctattatgatctaagaacataattttagaattccaattcttttaaattagttacagttttttcagggcccagaatatgatctatcttagtgaatggatgtgcacttgaggagaaggtacagtctgttgttgtcagatagagtgttttgtaaatgtcaattagatcaagttgagtgataatggtgttcagatcatctatatacttactgattttctgcctgcttgttttatcagttattgtgagaatggtgttgaagtctccaaatgtcattgtggctttatctatttcttcttcagatctattagtctttccttcatgtactttgatgttttattattaagtgcatacatgtttaggattgttaatgtcttgataaactggctcttgtatcattatgtgataagcccttttacttcctgataatttccttgttcttaagtttattttgtctaatattaatatagccactccagctttcaattgcttagtgtaattctgggtgatttttcgattgattccttcacattttgaatattacgttataaaaatctgactcctgttaaaatcctttgaagaaagttagagttcttatttacttttttcagcaggttaccaactggttagcttcagactccaaattctgttttcctttgccagtgactacagtcagttcctattttttcataaagtagcataacaaagctataaactttgctttactactctgtgtctgcacaatggctaatttgggatttggctgtagaattatgtaatagttctgatctcaaaatcttcgctgtgctgcttgcataggctatgcatgtgaggcaaccataaatgtgcagcttggagttgagtcaggacttgcgttcgttcattcataaaattagcttctagctttcttctctctgaaatgtcccccatctttccagctcctttggacttccttccctggatttttggctagaatgatatgatttcttttgaaatgtttgcctcccagcctgcctccaaatttgcataactggagttgttcttaggcaatgaggtaagaggaattcgagaaaaaaaaataacaaggacttcccccacattctttggactatagaggccccatttcctgatttctctggacagaaagatttttccccccgttggggctttagattccaatttggccacagctgccgcagtgcagctccttggctctgatcatcctcggagcagggcccagcagaaagaagacaaaacaaaacaaaaatgggggttttccctatactctctggcttgcaaggcattttgttctagatactctagccggaaaaaatttactttctctaggattttgcttccctagttcacagtttcacactgatactgcccttgggttaaagatgggaagtaaaggagggggaaaaaaaatgggaaactcaccctgtaacattcattcttaaagttttgtctcccctcctgatcagccttattgttagcttttcagagtcctcaggtagttactttatataatttttgcagatactgagttgtaatcagtgggagagataagctgtaatgggcttattccatattggcctgcatgggaagtccccctccaccacagttttctttcttccaatgcctttggcaactttccttttcccccccagtcagaagcctagcaaaaacttgatagaaatcattcataaccaaatattggcatgtaaaatctttcctttcttaaaatgatccatagtagcagagtaacattttccaaaggcaagactctaatgagcaactataggctgccaagccattaatcaaaattataccaacaccaaagcagttagccttgtgtgtgtatggtattgtttgtgtaatttcattatacttctggcaatgtatacttgttagttatgtttctattttggttttaaaaaatctttcatattagcaacatgcaaaatgaaatgtgaaatccttccagaaaaacatcagcagacggggtctacttctctagcatttaaaataatttggtttctaagaagccatacatttcttagattctttgtttatttttggtgaaattcagaagtcagtaaaatttaactcatatatttcaataacatacagatagcataccagcctgtttgattatatgcgtgcagtgtaccaactcatctttgtctttggccttaacttatgccttgtttttgactacatcttcagcagtacaagcccttatgcatgtttttcctcttatatataaaccaaagattccatagcacacaaataatatagaagaatcaaatggacccttctagttttataagctgctgcttcagagacaagccctgtttctacattgcattttccatacttctcatattatcatcagctccttctatatcccaaaagaatactaactactgatcgataacccggacatgtctggccatggcctacatgtgccctgggtagttcatttatttgtcttggtggatttgctagagtggaatttaatcaatagctaattcattaattctggtcctcgagaatgtagagactgacctggatgaagataacgggctgggtctggctttgatagaaatatgacaaacactgcagctgacagcttcactaggtactgtgctatgaagtttagttatttattccccataaatggagacactaagaaaataacacaaacaagaaagatgttttattacattactgttagtattccaaaatgcatcatttccaggcatgaggctcaagggaaagtagagaaagaactcagatcatgtcttttaatgtctttaattggaaccatggcagttttttcacatccaaatcagtttggggatgtgttattgataaggagtgtgaggtataaagtcttcgtagcactcacaaataattgttttaagatttgcttctagatgctgaatgagatcaatgatattcttatacacaaactttgcagaaatctttctgataacagcataggttagatgtctctaaatgaatgctaaaccactatcgttattaatgaatatctatatatttttttcttttttgttgttgttgttgagacaggatctcgttctgtcacccaagctggagtgcagctcactgcagccttgaccttccaggctcaagcaatacttcctcagcctcctgagtagctgggacaataggcatatgccaccacacccagctaatacatttttaaaattattttgtagagttggggtctcactgtgtcgcccaggctggtctttcgaactcctgggctcaagtcatcctcccgccttggcctcctaaattgctggtattacagatgtgacccacacagcacccggcatccccctatatttttaaattacttaatgtggggttaagtatggttcaagaggtcagagcttgtggagaaagaggattctccttttttcctcaccaaattttatgagacatgctatgatatactttttatgctatgacattagatatcagggaatctcttctatccttgattttttctgcctaacttttctcagtgaatgatagcttcaactgaagtaatgattttacagttttgtaaaattaaaagaaaaaattaatattttacatttaatttaattatttaacattacaagaaaaaattaaggccacatttctgtttgtttgctttaatagggagagtgttgggctgaaggatacagaatgtcaaatcacttgttttcacctgtataccaaacttgcttaccaatatgggcaattgtagactatttttaatatggactaaaactgtctgcttaaacctttaaaggatatgggtagaaccttgaaagagagaatttggactacactaagtgcaattcgtacagatccaatcaatagccttatggtcaccatggcttttaggaaatattactcatttgatggccatgagttctgattatcacattctgtttaaggagaccttaatagaatagtgtcagaatatagaatgtaaacagaaagacagaatatatagaaaagagaatattgggcttattattatggctctgctatcactattttcatttccttacctccctcttcttcccaaactcctcctaacttctttacctcttgtagctcccatagaaacagctcggtcgctgaagtagcctttgagtgcctttcagcaaaatccagttcttcctcctaattcactttagccctcaactgccactttgtccctggttctctaaacattcattgttttgttttgtttttattggttccattaaaaacccacttatgcattctgggtgtcctcaggaaaaagactccctaccttgctcaggtagttcagtcttgcaattttaagccatactgatgtctcaaagatctctggccctgttttcttcctaaactctaatcccacatacccacttgcctattgattttatgtcatgatattcacccatcacttccataaccatgagattcacaagttaattcttatctaactcatcatcttttccaacactcacttctgcaaatgtaccaccatcctgcatattatcgaggacatatatctttgaagtatttttaatcccctaagtttattaaacactgattttagtacattttctgttggagcatcttctcatatatgttactcttctccatttccaccactaccaccctggttcatgttttcatcgtttaagtttatataaccattttatggagctgtcttaatccaattagatacaaagagaaaaaaaaatcctttacttttcacctgctacttactgccttaaacacactgttttggctatccttccctcaattctcaaataccccacaggaacatcttatgggtttccaattatttttagttatgagtctcactttgataattaagattcatgatcaagtattaaaaagtccattccatcaccatcaaaatattagcctcgcatctagttcaaagattctatcatttctaaagctcaggcctaattgtagcttgctcttttcttccctcttactctttctttcctattccattttatccaaatatgttccctttcaattttattacttcactgccatcactgtttgacaatcacagctctccattggcaagtgatgctttcttgggcaattgtatgtttttcttgagaggtcctcatgagaatctttgaatagccaaattccctcacacgagtgttgccctttatagctgatcacttgtggtgccaaaagagcagaacattccaaagactcttcctgctggagtctcctcatgccagaaggccactgtcctgggccatgtaccttcaagttagctcaaacctagccatcttgcaaggcatccacttggctcttgagaaactcatccatctatgccatgctatagatcaatattgtggtattctaggcttaacctttcattgcagaactgctctggccaatctctggccactagaattctctaactgagaagtaagctttatttcctatgctcatacagactgccaaatttaagagttccctgtcaagctgtcccaagatctcttcaccacattttcctccaaggacaaaaggagggaaatgtgtgttcctttttattaaaagaacatgggttttgcattttgactttttacctactacaatttataataaacatctcagtaggataattaaatattcagtgacttgacttgaaagcaaagaattaaatttgtcatattacatttatttcatctttgttaaaagtgttctgatcatttttgataaccatgatctggaataatattgaagaacttgagtgttacataaatgattgacaaaaatgaccaaatcgattagaaaaaaagcctgtgtaaacataaccagataatctagagctatttaatccataacaatttaggttaatatcttagagtgtatgaagatttcttttctctggtcaaacaaaaatgttttgaaaaaattggggaaaaatattagaatgaaatgttaaagaatagtaatgtgaacctgtcttcataaaaatttgatctgacttgtatcattttgatattcacctgtgtaaaggtaagtgatatcaaattattttccctacactcctttgtatcttcaatggtattttgtacttcaagggacaactggaagtgatgagatctggggagggtgaaatgcatctgtaatcctaactagttgggaggctgagtcagaattgcttgaggccaggatttgagtccagcctgagcaacatagcaagatcccatctctaaaaataaataaagaagaaagtgatgacaactgtgggggtggcacaatagtatgtagtagtaacagtaataaaatagtaattctgctgacaatatgacataattaaaaagaaataactacaactagaatgtctgaacacttgatgaattcatgtaccaaaatatgtgtaaagaacttccagttccaaaatgatgacatagaagcaagctggcttcactcctctccacagaaaacagaaacaaatgtacagaactgagattatcacagcaatatcccagaactcaaatatgaggacaagacagttcccaaagtcacagagaagtgaaaatctccgagcagatggtaagaaaattggactttcatatccacaatgcccatctccccaatatattcagcaccacgcttgtggaaaatattttcctgacccttgatttctgcactggaaaagtgcgattgaagtggacagtttcccgaccgtcttaggttacctggcaggagacctttacctgcctcaacccacaggaagcatcaggagtgcccgaagggctctatctctgtgaggacatccagagacaatgtggggagatgggactaccatcaccagccctggaaattctgctctgtaactcagtaaaaggagatgccaaatcagagtggctgttcagcagcaccacactgtagtagttttgctccacaggtttcctgggcaccaatcctcagccagcctcctcacactaccaggatatcccctttggaacctcccctatttgggaaaggtggtattctgatagtttactggagacaaggcaaacctggacctgaggcaccatctagtgccaaaaaggaggcagtgacccagtgaattaaaaaaaatgaaagaaaatgaacagaaaaattacaaagaatctctatgcaaacatacctaagaaaaaccaaagcaagccagagaagactgcaataaataactaatccttcaatgcaaagacatagacatatatccataagaaatggagagaagagtaatatatgagaggatgctccaaaagaaaatatactaaagttgctgtttaataaattcagggaattaaaaataattcaaagatacatatccttgataatatgcaggacggtggtgtgtttgcagacatacaacttctttaaacagggaagtaggatcttctcaagctgacaaaagcaaggaaacagtgagtgaccctaacaagatggtgataggtgaactctatgaccaagaattcaaacagttttaaggaaactcatgatcaccaagatagtacataagataaattcagacatttctcaacagatttaacaaagagattaaaatggttcaagaaattaaaaaagaaatcttggatctgagaaatacatctgctgaagtgaaaaattcattagaggctctcaatagcaaactagatcagaggaaagcatcaacaaacttgagacaggctatttgaaaatacagagaggtggggataaaagaatgaaaacaagtgaagatcacctacaaggtatatagaaaactacctgaaaagacaaaatctaggaattattggtgttcaagaggaaggtaaacaagagcaagaggtagaaagctttttaaaagaaagattaacagaaaactttgtaaaatgtaagaaacagagaaatatccagatatagaaaggtcagagaagaccagatttgattaaaataagattattccaaggcatataacaatcaaattcttaaaggtcagtgacaaagagaggatcctaaaagcagcaagagaaaagaagcaaataacatatttaaaagcttcagtttgtttggcaacagtctactcaacagaaaccatacaagctaggaggaagtgggatgacattttcaaagtgctgaaataaaaaaacaaatgccatataaaagtactgcatacaataaagctatccttcaaatatgaaagagaaatgaagtccttcccagataaaaagctgaagtaatttaccactatgagacccatcttataagaaatactaaagagagttcttcaaactgcaagacataaaaaactaatgcacagaaagaaaacatttgaaagtaaacccactgataaattaagtacacagacaaacccagaatactctaatactgtaattgcagcatgcaatccactcatcacttcagtatgaagcccaaaagacaaatttatcaaaaacaatagtaggtacagcaacgtgttaagagatagacaacataaaaatatacaaattgagacgacataaagtcaaaatatggagaaatacagttaaattttagagttttttcattgtttctttgtttttggcaaccaagtacaataaccatatgatcatttcaatagatgctgaaaaagcatttgataaaattcaatatggctttattataaagtccctcaagaaactggatatagaaggtgcatacatcaaaataaaagccatgtatgacaaacctatggctaacattgtactgaactgggaaaaaatgaaagtctttcctggaagaactggaacaagacaaggatacccacttacacttttattcaacacaatactggaaatcctggtgaggcaatttgtcaagagaagaaataaagggcatccaaatcggaaagggataagtcaaattagccttgttaacagatgacatgctcttataattagaaaacctaaagactccaccaaaaaacctgttagaactgatgaacaaatttagtaaagttgcagaatacaaactcaatgtacagaaatcaatagcagttatatacaccaacagcaagcaatctgaaaagaaatcaagaaagtggtcccattaacaatagctacaaagaatataaaatacctaggaatcaatttaactaaaggagtaaaatatctatacaagtaaaactataaaatgctgatgaaagaaattgagtaagatacaaataaatggaaagatattccatgctcttggattagaagaattaatattattaaaatgacaattttacccaaagtaatttacagattcaatgtaatacatatcaaaagaccaattacattcttcacagaaatagaaaagtatttctaaaatttatatggaaccacaaaacacccagaatagctgaagcaatctgagtaaaaaaaagacaaagctggaggcattacactaccttacttcaaaatatagcacaaacctaaagaaaccaaatcaacatggtattggcataaaaacaaacacataaaccaatggaatagaatagagaacccagatataaatccatgcatttacagacaactcatttttaacaaaggaaccaagaacttgcaatgaggaaacagtctttttaataaatggcactgggaaaactagatatccatatgcagaagaatgatagaagagacagaagagatagacccctatctcttaccgcattcaagaatcaactcaaaatggattaaatacttaagtctgagacctgaaactgtaaaaccaatagaagaaagcattggggagatgctcccagacatgatctaggcaaaggcatttgtgtaagatctcaaaaacactggcaagagaagcaaaaacagaaaaatgggattacatcaggctaaaaagcttctgcacaacaaaggaaacaatcaacaaagtgaatagacatgccatagaatgggagaaaatacttgcaaactgtctatctgacaatgaattaataactgggatatataaatagcttaaacaactcaaaagcaaaaaacaaaaacaaaacatctgattaaaaatgggaaaatgatctgaataggcatttatattgcctattgcctattcagaagacatacaaatggccaacaggtatatgaaaaaatgttcatcatcactaaagagatgagaattgcaactcaaaaccataatgaaatattatgtcacccagataaaatggctttgataaaataaaaaagcaggaaataatggatgctggtgaagatgtggagaaaggggaactctatttacactgttggtgggaatgtaaatttgtacagccactatagaatattgtatgggggttcctcatgaaactaaaaattgaactactgtataatgtagcaattcactactgggtgtatatccaaaagaaaggaaaacaatatattgaaaagacacctgtactcccatgtttattgcagtgctgttcacagtagccaaaatatgaaatcaacctaagtgcccatcatgaatgaatggataaagaaaatgtggtacatatacacaatggactcttattcagccataaaaaagacttaactcctattatttacagcaacatggatggaactggaggtcattatgttaagtaaaataagtcaggcatagaaagacaaacattgcatgttctctttcatatgtgggagataaaaaagtgaacctcatgaaggtagagagtagattggtgattaccagaggcctgagagggtcatggggagagggagaggaagaatagattgattaatggatataaatttacagtttcaatgaagagataagacctagtatttgatagatcagtaaggtgatttatagtttacaatatcttttacatatttcacaataggtagaagggaataatttaaatgttgttagcataaagaaaagacaactatttaaggtgatggatatgccagttacattgatttgctctttacaaattatatgaatgtattaaattctcacatggaccctgaaatatgtacatctattatgtattgattaaaatatatttttttaaactccaggcttccccaagattgtaatccacctgtaatttaactgactgctagtaaagcctgttactttcagaggaaaacaattcaacctagagactttgcaaagtataatccacaatgttgtgtgtatgtgggctgtgtgtgtgtgtgaaggaatgagaaaatgtaacccaaacatttgagagagaaaaaaatgtgtgtagacatggtgacttttatcagaagttgtattaaggtatcttaaatttcagttcctattactttaaaatctaaaaaaaactataacagttatttcatgaacaaatctaccaaaaaaaattcattcaaatatttgcaatctgtttatgtttatgcatgagtgcccaaaagtatcttcagctctttttctccaatatttaacatttattcctgggattgaagaatgttccttctattttactcttaaacatcaaagcaatgaaactattaatcccgctaataatgatgcatatttctcaaagatgcctttcattttcagatcagcaaccaaaggagtttcaattgtctctccagttggctctaatgagagatgtacagatgttaaacccaatactcttcttaatcattttccttcgtgtacttgattaaatcctcaaaagcaaactgttcatgttcttgccgaaaatataggcggtctcacttaacagttatgttgcacaagaaagggaagttataatggcatggaacgtgctctacgtggtattttctagactttactagttcacgagcttttgtggataagtcaaactcttgaatgtcacttaaatgtaatcttttctgtagttgattatgcagagaatacaaaaggtatctgcagaatgtggaattaattttgaaagtttgataaaaacttcagaataatagctgtggctgtacaagtcatctatgaaactgttctctcataggtgacattaatttcctatctacagagttttattactgaatgtgttatgtttgtacccccacaaaactgaaataatagttttctttttttagcagtctatgaaaatgttgaggtttatcttgactgccgctttttaacataaatatttgggcttcattgaattcctaatatgtgatgtcacttggaattctgatagggtccagtaatttggcctgcaaagacatattttaccttaaaatgaaagggatagttgaaatgttattttacacgatagcaaaaaagcatccaacataagttgtgagatttttattgcttaacttttgaaatagaaggacaaggttcttatgtgcttgctttattccaaagtatatatgggaatgctaatgctttatatgtaaaatgtacgctacacatatttgtgattagttaatttttatggctagaaattctagaatcataaaaaagaactaatcttgaatgtcagagcttcacctatttttttaaaaacaatgagaacaaaaaaatcattataatttttatatttaccttgtgtttcacaaaaaggaggttttctttgctgtgctacactgcaagaatatgtcatgttcaaatctctggggctttattaaaaactttaactactgtcttcttatagagattattaagcaaatactaaagatagcatagatgtgtggtctaggcagtatttttctggcaagtagacctaagtgcagaatttaagttctgtaacattaacctgagactaaatcattttattcagggttgtctcctctgtgaacagctttatgttatgacctcatttgctacagcaaatgaaatattaatagatcattgaaaatgcagtaaagttttgatcagatgttataccttcattgtataccaaaccctgcctctcataaaaactttctacttgggtttaaattgaaattatcactcaattttttaaaatcaaacattttctttaagaacatgacaatgtaaacatatttcttacgggaatctttaagttctatatttttcaccaaaaatcatttcagaccatgctagttaaagagttattgaaaaaaaaaagaatctatttagatgagtcaaaaaattaagcaaagtatgttttaaataagttagtgactataaaatttctcaatttgggcatttattttgactgcaagtaacaaaacacctgacaaaagagacttaagtaaatagctctagatatatagttgactcttgaacaatgcaagggttaggactgctgatccccacccagtcgaaaatctgcatataacttttgactgtcccaaaatttaactactaatagcctactgttgaccagaagccttaatgataacataaaaaactgattaaaacatagtttgcatatatatttatactatattcttaccataagtaagctaaagaaaagaaaatctcattaagaaaatcataaggaagagaaaatatatttactattcattaagtggaagtggatcatcataaaagtattcatcctcattatcattatattgagtaagctaagtaggagaagaaagaggaaaggttggccttgctgtctcataagtggcagaggtggaagaaaatctacatgtaagtggatctgcacagttcaaatttattttgttcaagagtccgctgtggatagttgttggcattggtgaaccaatgccaaatataatggcggcatctttgtgattgttttggccttttcaaataactgaaagatgattgctgaagttgtagacatcatgtttagcggaaagaaagagaaaaggagaaggtggcagctctttcaagaaagctaaaatttcctaggaacctccataggagtcccatcatggtgttcccgtggcatctctgagcagttatgtttcatatcacaactcctaggtaaagtaaggcaaaggagaagcaggttagaagtaggcattaagttgccacatgttctaattgtcaccttgtttaccaagtcatgtatgtcttatctttgcttaccaaacaaaatgctctgattttcttgattagccatagtgacacttgcttcttgtctttgaaactgaaagtaataaaccacctcacgccatgtgttattcttccaaaagctaacataattttgattgatttgaaaatatatgatttcatatataaacatatataattatatatatatattagtatctattgctgccactttttacttaagactgatagcatcaatgttaaatagtgtcttttcagaagtattgattattctctctgttgcagatctcttcaaattgattgggtgtctccacggaagccaaatggcatcattcttggatatgatctcctatggaaaacatggtatccatgcgctaaaactcaaaagttagtgcaggatcagagtgatgagctctgcaaggcagtgaggtgtcaaaaacctgaatctatctgtggacacatttgctattcttctgaagctaaggtaagtcttttctaactaatcagtgaaccatgtttttctcactcaagactccaagtgaaattattagcttctcacaccatgatgtattatgatcaatatttccactactctatgaagaagactccacggaaaagaaaggatgcttacaaaaatcactatcaccctcatgagcactttagccttcccattttttattatcttcacaagaaatataaacttattagaatagggtacatcccaaattttatttgattgagtgacttaaaattttctttacaacagatcttttcagctacaaataggtgtttgtttatatggcactgatgagtaactgtgaggaggacattttatgatttgtcagaaatattttagcattatagtcatttgtagattaatgttcatattagatgcggtttagaaatcagatcaataatacagccagacagaggagtttgtaaatgacttttattgacaaacaacacaaaatccttagtttgaaggtagaattttatataatgaaataatgttcctatttggcaacaacagcatcacacattcaatggctaaagctactactaaatttataagatttactgcaaaagaacaccataattaagaaagtgagttactgaagcaatatggatcaaaatacaaattattatggctgacacaaatttagcaggagttatcatctaagaaatgcataaagccagcagttactaactgtgcattttttgatacttagactctaaaattatcattatgcctacatttgacatcattttatgccattaagtatgcacatatttaaatacacacatctgatgaacatatttgtataaaattaaatttgggatttctgagaagaaaaatactaaaataaatttgcccattaaacatatcctccacttaagaaaaacttgggaaaatgttggcaaaatacggaattcacttctcaatttttttctttgcttctattattttaatatttattatctgttacgaagtggacaaagagagaatagttgtataggcatacgaataaatgatttaaagtttgtggagtgcagaaaacaatgtgttccatcaaagtaaaaactgattctggccagaaactgtcatagtagtttaggtgtgtataatggatttgataagtttcaaccctataactttagtggcaaaatcaaagctaagtagagtaaaactagtaaagataatgtttccatttaagtttattctaaaagatcaaaaggtggatgttcttaaaatgttcatattaaattagaatatacctgagatagggtgaagaaaaagtaatgggatgaagaaaaatattaataaagtattaacagaataatatttacctatgtttaggctaaattatttataaaattactcctacctttctttatgctgtgatttcagaaaccgctttttgtaacttttaaaaatttactgaagctttgtaccaaataagtgactggttggtgtaacattcctaaattcagtgaatgacaaagaaccggttagtttaattttaaatcaatttaaaaatgatttagacaaatctactctacaaaaaaaaaaaaatcatacgggtcaccttttatagaaaataaatgtaaattgatgaatagggaagcaaaagttaggctttagaaaacaggcgtgtgcaaatctcaccacatagtcttgaaaagaaacatcacatttggttattcttataatgcaaatgtcataccttattacactaaaacgagacacactatttaatgatgccttaaacaaagtcttatttttattgttgagcttaaagaggcaacacaggtattgcggtaaaagagaataaaggatgtcagttaaatttcaaaaaaaaaattgtaaagttcagtttgggactaggtactaatacacatttcctagcatgaaagattggagagaagtagaaaagagacttgtattgcgggtttaaaagctttttggctaaatcactgtaaacatcaatgtttcccaaaatacttaaacaagctttaccataagattacagccatggttcacaaatcccagtgaacgtaagacctgggggaattgttaaaacctaggatttcatagctctagtcccagagattctgattcagtaggtttagatttggctgtgaaaatttgcatttctaaacatgttcccaggtgtcttagttcgttttcacagtgctataaagaattacctgagactgggtaatttatgaagaaaagaggtttgactcacagttctgcagacttaacaggaagcatgactgggaggcctcaggaaacttacaatcatggcggaaggtgaaggggaagcaaggaccttcttcatgtgatggcaggagggagagagagcgaaggggagagctgccacactcttttaaaccatcaaatctcgtgagaactcactcgcctttagacctacaataaaagtctctttcctacttctctccaatctttcatgctagaaaatatatattcatacctagccccaaatgaaatttacaattttttaaatttaattaacttcttctgttgtctttcactgcaatacctgtgttgcctctttaatcccaacaataagactttgtttaaggcattattaaaattttatataataaaaaatgtatatatttaaatatatctatttttattataaaattttatataataaaagatctatatcttatgtatatatacatatgtgtatgtgtaagatataagatatacatcttatatcttttattatataaaattaaaattttatataataaaataaaagatataaaattaaaattttatataattaaatacatattatattatatagtattataatagagcacaaagcatggttgaagacttcaaaaaagctgcattctatcaaataacatttataaaattcgaatgatcctggaaaatacatttttaaaccaacgaaatatgagtaatatggtctcagatcttctatgccttacaagaaaataattatattacatgagatacagtggtataacactcttaactaaactgatatttctttaaaactgttttcaaactttcaggtttgttgtaacggagtgctctataaccccaagcctggacatcgctgttgtgaagaaaagtatatcccgtttgttctgaattctactggagtttgttgtggtggccgaatacaggaggcacaaccaaatcatcagtgctgctctgggtattacgctagaattctaccaggtgagggttatttccaggtgtactcaaaaactatgggaacctgaaaacataaacacgtggttcatgtcagtgaactatttcaaacacctccctctcaacaaaaattgaaccataaacacatagccaatggcctgctctaaatattgtttcttccttctgctttgttaaaatataagcaaggctaaatattagaaaacgagagaacagaaggaatttacaatatctactacagaaagaaataaatctggagatctggctaactccttttatcttgtggctttttttattaacatgactatatattttcactattaaatatgtgaattgctgactgttccaccccatgaagctgttccccacttcctccatttctaatctgaactacacatgcattgttcttggatagatcgcaactgcaaatttcatttgtctgagaattctaggccactggcaatattctctcatcataagtcaggcaagggaaggaagaatgctgcaaagggtagcaaactggattttttccttcatccctttttagtattagccaacttagctagccattttgctccaaatttcaactacataaaacaatgcctagtgaatataattgggaatgatgctaataataactgccatttttaaagtaccaagtctctcgcaggctctgtattgaagactttacatgggataccttatagaatcttcacaactccaggaaatttgtattatacaaggcagtttacaagtaaggaaactgttttagagaggatcaataacatatccagattcacagatgtgcatagaagtgaaagaactaaaatgtgaatataagtatgtctctcctaaatctatgctcttttgtgtactttactgcctctttaaccaaaaagcatcaacctcttttgacaatttttttaaaaggactatttaagacttctaaacttcttcattactaccactgtcagttacaatttatcctgcaaaagtaattgagaatacaaaagtaattgagaatacaaacttttttctactacttaagtttgatactgatatcttctttaaagagcaggaaatggatataggagaaagacaagaaagccaagttttttggaggccataggaaagctgaatactttgagatatctagtttagggtgaaatttatgcccaacgtctggttcctgtaaattatgttcagtataactatatccatccaaggcatgtgaaatgagacactgtctaacccagtgtctgttttgcaaaatactggagcaaatatagaaggcgtgcaatcacctgatgggttcatcttgcccattgcacagatagagccaatttaccaaaacagtggtattgcaacagagaaagagcttaataaatgcagagccagctaagcagaacaggaggttttactcaaaacagtctcccagaaaattcaaaacctagggtctgtctgggcacggtggctcatgcctgtaatcccagcactttgggaggctgaggcgggtggatcacctgaagtcgggagatcaagaccagcctggccaacatggctaaaccccatctcttgtaaaaaatacaaaaaattaactgggcgtgtggcaggctcctgtaatcccagcttctcgggaggctgaagcaggagaattgcttgaatctgggaggcagaggttgcggtgagccgagatggtgccactgcactccaacctgggcaacagagtaagactctgtctcaaaaaaaaaaaaaaaaaaaaaccctaggggtttttttggttggttttttgtttgtttttgttttttgtttgtttttttatttgtttgtttgttttgagatggagttttgctcttgttgcccaggctggagtgcaatggcgtgatctccggctcactgcaacctccacctcccaggttcaagcgattctcctgcctcagcctcccaagtagctggaattacaggcatgtgccaccacacccggctaattttgtattttcagtagagacaggctttctccatgttggtcagggtggtctcgaactcccaacctcaaatgtctgcccaccttggcctcccaaagtgctgggattacaggtgtgagacaccacacctggcccagcctagggttttttttaggatagtgcagtaggcatagggctagggaatgaggaatgcttattggttggggataaaattatagggagtcagagctgtcttcttgtccttagtcagttcctggatggggactataggatcagatgagccagtttactggtctgggtgatactagctggtccctcagaataaagagtgtgaaaaatagctggtccctcagaataaagagtgtgaaaaatacgttgaacaccaatcttaggttttacaatagtgatgttatctatggaagcagttgggaaggttaggaatcatgtggcctctggtgccatgaacacctaagccgtagttccttgtggctaatttgttaattttataaaggtgctctgccccccaagcaaggagcaagtttgtttcaggaaaggactatcatcagtgtttcgaagttaaactaaacacctctcatagttatcttggcctatgcccaggaatggacagggtagcttgtaggctagaagcaagatggaattggttaggtcacatttctttcactgtcataattttccagtgtcaggattttcttactgtcataatttttgcaaaggtggtttcaggtgtcctgattaaatactgctcaagttttctcaaggcagagaaccttcactcattatttttccttataattaatagaaaaaaaaagtttgtatagcagtgctgttatttcttattctctatcaaaaatatttcaaaattgaataagttctagtaaaccagattttccacttaagaaaaagtaaaaatatatatggaaataaggattttgtagaaaactgttaaacttcttcatactacagctcacgatgtcaacaatggatcaaatactgttaaatgctttactttctcgaagtaacttaaatttggggagttttcatgtatgattcatatctgcccttgattacaaatcattgctataaaattataattacagtgatcagatggacgttttgtgttgttcaattcctaccattcttcacaccagtagaccaagttgatcatggaactaagtaatagtgttttcatttccacatcacattaaaatttttatgttatgatttgcaacaaactattcaaactctacaaaatatcctctgtcccttaaaactaatgaaaaattcttagttacatcttcactgctgctaactcaggagactggcctgtgactttctcaatgctaacataagtagtcagattttgaaccgacagcacaatctacttttgttaggtttcaaaataaaatttaacatttttcttaaaaatgaaataactcatggaagctcagaagttgtcattgatattatataagcctttaataattaatttttagaccaaggatttaaaaaatatgtattgtctgtatgtataaatacatgtttctgcacacctaaagcattttaatatctaccaaaccattgagcatgccccaaattttgattcttttttaaatagttcatttttcatagcattagaatgcataccctggtgtcaagaaaaaaggaaaaaagcaatctcatgaaataatcaaagagtgttttgctccaatcattaatcccactgtacctaaatgaagagattattttgtgacctctgtcctcagccccgtggtctttgttagctagtttaacactggttacactgagggggaaaaaagcgcaatggtcccaaatcctgttgcatctaaatgtgatttaaatctggtcactagtctgccagttcaaggccaagatgggtataggcattttgatatttatggattagcctgaaatattggtaaatacgtactttattttttttctcatgactttcttccataacaccccataacaaacagcagaagaggaaagaatgctcatttctctcccttttttaataaatatgctaataaccccaagtaaatgttaatgtgggtcattctttgataagaataacaattaactgttagactgcatggtagtttttagagagaaaacattttcaagcctggcctgaaatagattcattttgagaggttaatgagaaggtgactgatccttgtatcttatgtctaatagcccctttttgaggaaaaaaaaatagttttattttttattgatataatccacatctttttttttttgaagacttttcttctgtcagtaactaaataagattctgagggattcagaaagacatagctaaaatatctaaaccaattaacatttattatgctcaaaagaggctttaaaaaaaagtattggctttcgccatgtagatgtgtatactatgtttcctctaagctcaccattgtcctgagtggtgtttaattaactgttgttgccctgtaccatgggatacattatcttaaagtttaccatagagggacattatgttctttgactgtgaagacaaaaaatatggcaactacatttcagacgaaatagaattattttacccaggggaagataacaaatacagtaactttactgtttacaataagctcgttgctccttcattggtctctggtagcatcatcatggaaacttttactaagttccctttttcttagagataccatattataggatcctttcaaagataattgactaagccaactgtctcctgaattctagaaattcatattttgagaaaatcctgagtatgtcttgatccggtcctggatatttaccctagagaaaagcaaatttatgtttacacaaaaacctgtacatgagggtttacagcagctgtaatcattactgccaaaacctggaaacaattcaaatgtccctaagtgagtaaatggacaaatgtggaacaaaggaatactatgtagcaataaaaaagaacaaagtattgataagtgccaagaagatatcaagcccagtgaaagaagccagtctcaaaaagctaccaactgtgagactgcatttacatgacatactatacaagacaaaccatagttttggagaaaaaagttgacaattgccaagggtaatggatgggaagggaatgtgactatacagggatagcgtgagggtgttctgtgggggtgatgaaactcttttgtatcctgatggtgtttcttcattaaaattcatggaagtgtgcacccaaaaaaactaatggtcctgaataatatttttaaatgaaatatttttaaaacactatttccattttacacataggaaaaatgggacatagaaacatgaccaagacactcagctagtcaaaataggaattttcatggttaaattttaggttgagctcctagagatggtgtgttttataataatgtgatgactgtgtatgagtgacttaatatatttttctcatatgttagtagaacagtaagatagcaaatatatttccattaaaattacaatgaacatccctatctttaaaagaaagcaaaaatgtcttagtcagtgatgactatttcaagtaatattttacatgatcacattcttatgaaagcataagttttgtgtagtgtttccgtggtttgatgctgaataattagtgaataagatattggttctggagtcaaactgcctggctccatatcccatttctttcacctcttagttgtttgaccttcattaagtaactttaggaatattagcagggtattaatgtttctgatgtccattgggctgctgagttagaatactcaaagctaaccctatcttttatatctaaatagaaaaaaaatgtttagtaattgaggagcatatgagtaaagagggctaacaggcctcctttaaatgacaaagtttctaatgaatctttccagagcaaggactcaggggtgtccactttcatcagatcatgtaaagggatagccagttcccaaaagctaagattcaaacatctaatgacctttgagatcctatgaaacaaaggatccttgttgatcctatgaggccaagcaattctctaagttgacttttagcaactagccagggaaagtcatgaagagcttccaaactttgaagagaaaaagactttccattttgcaaaatgtcacagcctagaatttaggtcctagaaaaagcattttgttctgacaaaattgacatttagagactttatgtcgattgtatgctaccactattgacaaatagagggaatcaatttttcaagtctatctggagaacgtgacagatgatcattcacatattgcacaacagttgaatcttataggggaaattaaatatcgctcagtttgtttcctattgctgctataaatcatgaccagacacttcgtggcttaaaaccacacaaacttactttatacatccaaatatcaaaagtttgaaatgggtctcattgaactaaaactaagaagttaacaagagctgcattcccttctggaggagagaatccattttcttgccttttccaccttgcagaggctgctcacattctttggcttgtggaccccttccattttccaggccagcaatgaccagttgagcctttctcacttcatattattaaacttaatcacatctgttgtcttcattcccctttgccatgtaacataacatagtcacaggttccagggattaggatgtggacatcttagggaggccatgttgtgcttaccatggtaaggtaatggttaagcagttgtgagaattaagaaagcattgtcgtaaactcttggggaataactgtcacaagtgaaacaaaaaaagatactgtgagcctgagtgcaagaatatatgaaaaaaatgctaagtatagatttgctataaattaagcagctgcctcagggagtggcagtaggatgatattagggttgggaactacagggaaatgggggagtgcaatcttgttaatgacacttaaatcttgtacaaagtggtacacaagtcttttatcattttgatagagtgaacagtgaactacaaggactggtacaggggataatggggtgttatgccaagcgaggtaactttctagaggtatgtagatacaatggaccaagttattaaatattgttctttttagtagattttgggacagtttcaagaaatgcatagccagattgatagacatctttaaggggttagcatcctgtatgaatcccacatctgagcagtttttgccccagaggatcttggagacacattcaaagtcagagatgttgataacaaaggcatcaggtaattagctggtgctaccaccaaattataggccaggcattcttctcctgggagttacagaaagagactttcaggtgcacatttaatgctggtatctcatttacaaagtggatctcttctcaacagatgcactgaagtggaattactaaacaaaaaatatgttgattcaagagaaagaaaagaaaaataaaggcagaatctgaaaattatttgatatgtgtaccgctgagacatttggttattcctagaaagggataatggaaaattagaagggtttttgatagataatatacctaccaccagtatcaatcttctatttttacaattgcatagaaatttctcactttctatgtcaagggcagttatggatagatgagagcagctactttcacagagaggtgctgttttgtcagtttgtccttttttttttttttttttgattgtgtctttctaagatacactaataaaggcaaagtaggtgttctcccagtgtcccttacaatattgaaagttgtttttgtgcagactagacatagaggtgccctcattcttggctttatctaattgcttaatcccaaaagctgttaatgtggtctgaattttttttctttttttctgagccaaagtatcttctaagtgcttagcaagctcttgtaatttagaaggaagggacaatctactgtcttatcttctgttttatgggaagttatgataccttcttcactgatctttagagtattctggaaggtggtagttaagtgatctctgaagccaggcatggatttattttttccttgtttacaggacttttttgtggtaaagtatacaccacataaaatttatcattttaaccattttttaagcacacaattcagtggcattgagtgcatttgcattgttgtacaatcattaccaccatccatctctagagctcttttatcttctcaagctcagactctgtttccattaagcactaactttccactccctgttatcttcaacccctggaaaccaccattctgtttttggtctctatgaatttgactactctaggtacctaatataattggaatcatacaatatttgtctttttgtgtctggcttatttcacttagtgcattttctttcttttttttttattatactttaagttttagggtacatgtgcacaacgtgcaggttagttacatatatatacatgtgccatgttggtatgttgcacccattaactcgtcatttaacattaggtatatctcctaatcctatccctcccccatctccccaccccacaacaggcccctgtgtgtaatgttccccttcctgtgtccatgtgttctcattgttcaattcccacctatgagtgacaacatacggtgtttggttctttgtccttgcgatagtttgccgagaatgacggtttccagcttcatccatgtccctacaaagaacatgaactcatcattttttatggctgcatagtattccatggtgtatatgtgccacattttcttaatcctgtctatcattgttggacatttgggttggttccaagtctttgctattgtgaatagtgccgcaataaacatacgtgtgcatgtgtctttatagcagcatgatttacaatcctttgagtatgtacccagtaatgggatggctgggtcaaatggtatttctagttcaagatccctgaggaatcgccacactgacttccacaatggttgaactagtttacagtcccactaacagtgtgaaagtgttcctatttctccacatcctctccagcacctgttgtttcctgactttttaatgatcgccattctaactggtgtgagatagtatctcattgtggttttgacttgcatttctctgatgcccagtgatgatgagcattttttcatgtatcttttgtctgcataaatgtcttcttttgagaagtgtctgttcatatccttcacccactttttgatggggttgtttgttttttcttgtaaatttgtttgagttcattgtagattctggatattagccctttgtcagatgagtagattgcaaaagttttctcccattctgtaggttgcctgttcactctgatggtagttttttttgctgtgcagaagctcttgagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttgatccatcttgaattgatttttgtataaggtgtaaggaagggatccagtttcagctttctacatatggctagccagttttcccagcaccatttattaaatagggaatccttttcccatttcttgtttttgtcaggtttgtcaaagatcagatagttgtagatatgtggcattatttctgagggctctgttctgttcctttggtttatatctctgttttggtaccagtaccatgctgttttggttactgtagccttgtagtctagtttgaagtcaggtagcgtgatgcctccagcttttttcttttggcttaggattgacttggcagtgtgggctcttttttgggtccatatgaattttaaagtagttttttccaattctgtgaagaaagtcattggtagcttgatggggatggcattgaatctgtaaattaccttgggcggtatggccattttcgtgatattgattcttcctacccatgagcatggaatgttcttccatttgtttgtatcctcttttatttcattgagcagtgctttgtagttctccttgaagaggtccttcacatcccttgtaagttggattcctaggtattttattctctttgaagcaattgtgaatgggagttcactcatgatttggctctctacttgtctgttattggtgtataagaatgcttgtgatttttgcacattgatgttgtatcctgaggctttgctgaagttgcctatcagcttaaggagattttgggctgagatgatggggttttctagatatacaatcatgtcatctgcaaacagggacaatttgacttcctcttttcctaattgaataccttttatttccttctcctgcctggttgccctggccagaacttccaaccctatgttgaataggagtggtgagagagggcatccctgtcttgtgcccgttttcaaagggaatgcttccagtttttgcccattcagtatgatattggttgtgggtttgtcatagatagctcttattattttgagatacatcccatcaatacctaatttattgagagtttttagcatgaagcgttgttgaattttgtcaaaggccttttctgcatctattgacataatcatgtggtttttgtcgctggttctgtttatatgctggattatgtttattgatttgtgtatgttcccattcatgttgtcgtacgtgtcaggattttattcctttttaaggtcgaataatgtctcattgtatgtatataacacttttgtattcatttattcatcagcggacattggggttatttctgcctagtgactattatggttaaagctgccataaacattgatgtagaaatgtacaaatttctgttcaatctcctgttttcaattcttttgggtttatacccagaagtggaattgctggatcatatggtaattctatgtttaattttcatgttaagaactgccatactgttttgtggaacattttaacattttatattcccaacaacgcataagtgtgccaatttctccatattcttactgtttattattttatgttttttataactatcctaatgagtatcaagtggtatctcattgtggttttgatttgcatttccctacttattactaatattgagtatattttcatgtgtttattggctatttgtatgtcttctttggaaaaaagtgtctattaaagttatttgcccatttaaaaaataaggtctttgtttcatgtttttgagttatagaagttctttatacattctggatactacttccttatcagatatataattttaatatattttctcatgagttgccttttcactttgttgacagtgttctttgatgccaaaaagttattaatattaattatgatgaatccaattcatcttttttccttattgcttctgctttcagtgtcatagccaagaaatcattggcagacccaatgtcatgaaatttcccctttgctttcgtctaagaattgtaagttttagcttttacatctagatctttgatccattttgagttagttttggtatatggtataaagtaagggttcaatatcattctttggcatgtggatattcaacttttccaacattctttaaaaaaaaaaaaaggtcctttcctcattaaatggtcttggcacttttgttgaaaatcatttgcccatatatgcaagggttcatttttaggatctctgttctatcccattggtctatgtgtctgtctttgtaccagtaacacacttttgattactgtaactttgtagtaagttttgaaatcagaaagtgggagatctccaactttgttctttttcaatgttgttttgactatttgcagttttttgagattccatgtgaattttataatggcttcttctgcttctgcaaaaagcattgggattttgatagggattgaattgattctgtagatcacttgagcagtactggcaccttaacaacattaaggctcccagtccataaacatgggatgttcttccatttggttatcttctttaatttctttcaacaacattttgtagtatttcagtctttcgctttcttggtaagctcattcttaagtctttctttttttgatgttattgtaaatgaaattatcttattaattttattttcatgttgttcattcttagtgtatagaaacatacctagtttttctatgctgactttgtatcttgatactgtgctgaattgtttattagttgtaacaggttttttttttttttagaatctttatagttttctctatatgatatcatgttgtctgagaacacatagttttgcttcttccctttcaatttagatgccttttatttttttctcttgcctattgctctagccataatatccaatattatgtagaatacaagtggcaaagggtggcaaccttttcttgtttctgattttagaggaaaagttttccgtctttcactgttgagtatgacattaggtataggtttttctcatatactcttgattatgttgaagtagttttcatctattcctattttcttgagtggatttataatgaaagagattgaattttgtcaaatatttgttctacatcaactgagataatcatgtgtttcttttttttcccctttgttctattgatataatgtgttacattgattaaattttcatatattgacccatcctggtattccagggatatatcccgcttggtcatgttgcagaatcattttgatgtgcttttgaattcagtttgctagtattttgttgaagatttttgcatcaatattcatgagagctattgattttaacttttttcttgtggtttctttggtaagttgtatgtttctagtaatttgctcatttcatctagtgagatggatttttggccaataaatttggaaagaaaagatctcaaggatagctgctgagagttattgtcttattatttatactccttatatatctatgtttaattaaatattgtcccatatttttatatcattttggtaaacagtacatcttgcttttactaaacaaattttaggatatccagggctcaccaaaaggtgaactaattgagaagaagtccaggactataaatccctaaggcagtcctaaattcttcagtggatttgtgccatttcttaagaaagcttgacaagtcattaattggattatagaaatcttacctggaccatggttgaaggccataagacccatcagattggtcatcatactcacataccttataagatataatgaagagatgttgtccaggggaaaagatatgttcaagaaagaacggtagagaaaagggaagaaggtctgttgaaggtgtaggaagaagaggaggagcaggacaaaagagagaaggaagtcagggttccgaaggccacgagggaagacaaccacagtggggtcatgagatagagaagagaaatgaagcttggatttcagatccaccaagtttttattagttcttttgaaggtatccttaagggaagccatttacaaaatcttctgtcctttagagttgtctttataccaaacaaacaaacaagctaactcttggtatttagagtatttgagtcctttgattttaaggtaccaggcaaaagattatctaattctgttttttgttttttttgtttgtttgtttttgttttttagatatgcccaggctggagtgcagtgaaacaatcctggctcactgcgcactctgcctcccgcctcccgggttcaagcaattctcgtgcctcagcctctcgagtaggtgggactacaggcatgcaccaccaagcctggataatttttttatttttagtagagatggggtttcaccatgttggccaggctggtcttgaactcctggcctcaagttatccacccacctaggcctcccaaagtgttgggattacaggtgtaaagcaccacacctggtggattatcttattcttatcccaaatttcccagactgtcatgtgaagagaaatgtagtaaaattcagtgtgtgacatagcccagagaagtactagcacactgacttaaatacagtattttttacctcctctcatgtaattaaccttcccaatgggagtattttgtttggttgaacaaatatagtttggtcaaggaaattatagtcataagcaatataaatttatcaatagttggtttttgaatccactctacgttccaaaagaaaattacacagaacaaaaaagtattcctagatgtttttctataatgccacatagtccatgtcaccagacctgatggtgaggaaatagacaacatagacttacctgtaagttgccatgtgtgtatctgatctgacacacgtttatacacaaaaactttggagtcatttggaaattttgcaactccaatatgatattattctctttagtaattctgtcaatcagttgggatctgcaagatgattgtgataaaagttaattgttagtcatagcatatttttttaactgatgtaatgattattattgtcctaaattgacaggtgaagtatgctgtccagatgaacagcacaatcgggtttctgttggcattggtgattcctgctgtggcagaatgccgtactccacctcaggaaaccagatttgctgtgctgggaggcttcatgatggccatggccagaagtgctgtggcagacagattgtgagcaacgatttagagtgttgtggtggagaagaaggagtggtgtacaatcgccttccaggtaaggggcccaggtctacctttcagtagatggaggatctgagaagcagagagagtgagaaatttgccctagaaataaaacaaataagtaattaaagctcacattggttatatctaatgcaataattaggaacatattgtttaacacataacaatgtaatctcccaatttttacatgtatctcatgtatttcataaaaacgcatcaattttttttcctcttgaaaaggtcatgtcctccaaaaaaaattccacacatgaatgcattggttatgaatgaaaagaatatttcctagcaaatagtatacaaaattattataatgatattttgttataattcttttactcccttattctactgtattaagctaacactaatataaataacaataagtatcattgaatgaatactaacagacactgtgccaatattttatatattattacctcaaataatcttcacaataatcttacatgataggtactatcaattatctgcattttaaaaatgaagaaactgaagttcagacattagatattagacattatcttgctaaataccacacagtcagatccagattttgggaagcctgacatttatgttattggaggtggggcttttaaagacaagaaaattaaaatatgaagttaatgttcacagtatcttcaccaggcatagattccatctcaagaagccactttctttgctcctccctaagaagcaactcctcatctgttagttttatgattgcagcaattcagttacctcttcaggcttcacttctcattccagttctcttgctatttccactgcatctgcagttatttttcccattttgagtctaaaaccccttagtcatccatgagggttggaatcaacttcctctaaactcctgttaatgttgatattttgacttcttcccatgaatcatgaatattcttaattgcatctagaatggtgaatcctttccaggttttcaatttactttgtccagatccatcagaggaattactatctatggcagctatagccttacaaaatgtatttttaaataataaaactggaaagtcaaaatgactacttgacctatgctgtgttaataggcatgtaaacattaattttcttgtctatttccatcagagctcttgagtgaccagatgaattgtcagtgagtattaatattttaaaagaaatatcttttttctgagcagtaggtctcaataatgagcttaaaatacatagtaaaccatattgtaaacagatatgtaatcatacagcctttttgttccatttacaagcacaagcagaatagatttagcataattattaagggccctagagtttttgcagtggtcaatgagcatgggcttccacttaaagtcaccagctgctttagccccccagcaggagagtcaacctgtcctttgaaactttgaaaccaggcgttgactttttccctctacctatgaaagctctagttggcatcttcttccagtacaaggctatttcatctacaatgaagatctgttgtttagtgtagccaccttcatcagtgatcttacctaggtgttctgggtaacttgaggcagcagtttctacatcagcacttgctgcttcaccttgcacttttatgttatgaagatggctttttttcttaaacctcatgaaccaacttctgttagctttcatctattcttctgcagcttcctcatctctctcagccttcatagaattaaagagagtaagagccttgcctggactaggctttggcctaagggactattgtgactgatttgatcttctatccagaccactcaaagtgtcttcatatcagcaataaggctgtttcacttattcataagtgaatgataagtgaaatagaaatcttacctggaccacggttgaaggccataagacccacaagatttgtcatcattctcacataccttataagatataataaagagatactgtccaggggaaaagatatgttcaagaaggaatggtacagaaaagagaagaaggtctgttgaaggtgtgggaggaagaggagcattttgattttcttcaagaactgttcctttgcatgcataactgggctaactgttgggcatgagaggtctagtttttggcctgtcttggctttccacatgccttcctcaataagcttaatcattcctagcttttgatttaaagtgagagacatgagactcttcctttcacttgaacacttagaggctattgtaaggtaattaattggcctaattttaatattgctgtgcctcagagaataggaaggcctgaggagagggagaaagataaaggaacggctggtctgtgaaacagtcagaacacacaggacgctcatcaactaagctttccgtcttatatgggcaaggttcatgacacgctaaaacaattaccatagtaacatcaaaggtcattgaccacaaatataaatataaaatataaaaattaaaaatataaaaatataacaaatataataataatgaaaaagtttaaaatattgtgagaatcatcaaaatgtgacagagacacgaagcgaacacgtgctattggaaaattggcaccaatagacttcttgatgcagggtggccacaaaacttcaatttgtaaaaaaatgcagtctctgcaaagtgcagtaaatcaaagcacaataacgtgaagtaagcctgtgatactaaactactatatgcctttttaactcttattctctcctatgtgtacagcagagcttttcagatgttacatggcatgatttgcaacagatcgaatgcagactcagaaagaaaattaaattgacttctcttaactaaacatttaaaaagcttgcaaaaatataacacaatgtcattcttctattttttatttgaaaaacatttattttcataaatatgttagaatgttatagatttattattttatgtctaaatgcattaataaatatttcaaaaatttctgccgtaagttttaacacagtacatatcaacaggtaaaacccatataaacaaaaggtatttggggtcctcaataattcgtaagcgtataaaaggatcctgagaccataatttgagaaccactgcttaaagtcatagtaacgtctactagaaaattatggcaactaattagttatcctgtactatgactaaccagttgaatacctcctcctcctttagatgaagtagctaataacaggtctattaaagatagaaccaaggtggcagggagggtgcaaaagtgttacctcctgtgtactctaatacatcagagtttaaaaatgacagcaaaatatttgattttagtgtgtttgttcatctgtagctttttaaaagaattagtcaactgctatactccgtcctttgttaaatatgtattatgtagtaaccatattcaagacatcattcttggtgctttgcaagtgtaaaaatggccaagattccgtttttatcctcaagaacttacaacctaatcaaggagaaaagtgcctacaaggttatacacagaccataagagagggatgaatgcatgcatattcttaagacggagagatcactccagtcaaggtaatgaagggggttgttccattggattggaatctcaaacagtgagtatgattttggcaggtgtggcttgagctaaactgtgaaattagcaatctgcaaaacacaaataatagcgtgtgctttggtttacaggaggtatacactctgtgtaaggaagaaaggagataaatctgagtaggcaaaaggatttgaacattatttagcactcagggaagagtcaatatgatgataagaactgtagtttaagattaaatttaggtgtcagaacaaatacaatagagaaggaaagagaagtcagaacacccctggcatgaagtaaaatacatctgttctaagaagtggaatggaggttaccgtccactaggacaatggttcttaacttgttttccttttgaatcttttggaagttacaaaccctcactctgaataatagtgcatggaatatacacaaaaatttgcctgtaattttatccacccttgaactccatccatgaactcaaatttcagaatcacttctttatttactccaagatgatgtcgcatgccagtcaaacatttcttacacaaatggtgacagccctcaactcttgcgaatcaagataagctctagagtttctcatggcattctacagctctgccaactctgataatcatagtggacttaaggaataatagttttacaaaggaaaaaatatatctttttattctcttgactttctttctgcaggttgcactgaaaatagacagattccacatgtatttttcctctctctgctgccgttcactcctgtagcccctaatgactgtgaccttaatgaccttccagaatatccatatggccctttttctcctcaacctagcaacaaacagcatacctgctacataagtgtttggatctcataatatcgttcctaagcctggcctctctcgctgcctggcattgtgtgcctgccacgagaccgggctggctcgtaaaacatctctttatgtactttattacttaaactcttttatttgcctgcaggagccctttaacaaaatcacattgaattgactttctcacaccaaatcaaatctccctggtcccagttcagttgtctttgtcaatatgtattttataaatggagtgaattaacagatgctgttggaacagaagtgctggggtggcgtttatgtttttagtgctctctctgggcagatgcgttgtgtagaagtgttatacaggtatctcgggatgaaagtcatgcgtgtcatttcagtggatatgtattcttagccattttctttgaatagattttaaacctatttattactcatttttttcttagtgtttgcttatatagctttatcatttatgccattaatcttggattggacttgattatatcccttagtatgaaaaggtgaaaaattaaaacctccgtttcattcaaagaggacagatttttctattagccatgggaaactgatcatgagatgactttggaatatattgacttatttatattataaactttgtccatgcggcctttgatgtgaaactctgagttgaaattgtttcagaatacaagactgagttttcatgtcctggactctgacttcagtagaacaaatgactatcgctgtttgtttcataagatgggaatttgggaattttgcagagggaagtataattacagaagtccatggtgtaagggtggcattgaaaaaacatttccctggaagatttccataaaacagaatgattttttttttgaaaagtgtaatatatcagtgctataaaatgtatcacaatgatttggggagcatttttactctaccctctgttttgtggtggtagtcacagagccatctactggtgaagacaagtgtgaatttcttttctttcatgctctgccacaaatgttatacatttgtcctaaggatgactaatcacaaaccttttttttcttctaggcctaaaatatcccttggcttaaaatttggtccccatgaacaatctcagagtttcacaatgatttgtcatattccagactggattttactactatactatttttatctcaaaggcatgatacataattcttggtcttctttaaaaaaaagtggaatcccagttttgcagtcttaactatttagaaattcatccaacagatatgcttataaatgcttttctttttagacatagatatgaaataagcattggtaacatatttgaagtattaataatattgtgagtaaaaattttttcctccactattttctcagttgtgtccaatcaatggaaaccattggatatatatacagtttagaaagacaatatatgctttttcatctgaaaaataaacacctactagtttaatgtgtactgtaccactttactaacatctgcattttgttcaaagacacactccaccttttgtacaaatttaatgaagaggctctggaagaatggaccaatccatcaataatgcatgacctattttgtttttctttgggcatatttaaaatcgtgcattccgtgtgtcaaagttcaaaagtcaagtgctacatgtgataaattaggtaggggtcgaaagttattgcaatgcagtttcggaagattgtctgtctctgaatttgcagctcattcatgctgaagtgatgcactatgggaattactaccaaactctgctccgcaacatctgctctccctaagtgagttagtgcacgtcagacatctttatgtcagaatattgcagtgatggatgcagtcttcagaaaatgctgcataaaaatctggtgtgccgttctggccattaagtgaaattactatttaaattaatggcactgtcacagtttatctgtgcaaagaatgaacgctgattagggtattaagtaattagcaatttatcacactggaacaaggttgataataattaaagaagtaatggtttaccaaagaatctaaaaagggagtcacttcttgttatgtgagtgaaatcttggctgaaaatttcaattcagtaatacaaagatgaagctctttgtgaaagaaggcatcttttttttctagtttaaaaacagttcattatcaaaattttagttgacctgtcagaagtccctcagagtgatcagatgactgattaggagtttcaaattaggtcaatgtctgcatttttattttatacttaaagcatagtgaaaccatgaagtaatttgggaatgagagggggagaatatattccgctccctaaagggccagttttcaaattttgattgctctttaaaagagaaacatgaattgtcttcagaaaactgccagagaaaaaattaacagtaaaaaaatccatggttgtatttaaatgtctaatcagaaggggcagaaaaatgcccgaacaatataaaacttgaagctacggatttttctttttagtttatgtgtgtgtgtacactcatgtatgtatatatttatatgtatttgtgtgtgtatatatacacatacatatgcatacatacatagctacacacacataaatatgtgtatttgggtatgtacttatacatacacacatatatacccaccataatccagactcagactaaaatgagccctgctctttgtattaatttgagataacttttcctagaaatgttaaaaccactaaaattataaatatagcagttaatttgtaaaccaattacttcgaagagttatcacattagataaacatggtatgccaaagctctgttagaatcagtgtatatcattaatcataaataagagtttttaatattagagacttttgtaagtaaaaagatgaatgagagggttctttggagtcatgtgtggataaacatctttcttaaggcatgtgccaaaccaatgtctactttcaatgattttttttaaaagcacttttgatcttttatttgagtgtctttaataatgtagatgtttacacaggaccagattaaacaattcaggaccccagggcactttgaatttgaggttctttatgttatcagtcggaactaataataaacaaacaaaattccaattaaaataaatcattcatcacattgtgctgctatataactggatataaattctaatataaaaacactgtgacatgcagtatagccaccttgatttctagcttgatctgtctctagagtagtgttaatttattcctgctttaatgttaaaatttctgccatttctctttgatggcaatatctaaatgatgcaaatgcaggtaattaaactaaatttggtgggagaaaatgtctatttggtatctcaggtacgtgtgtctttcgtttagatgtggggatcagtgatcctctctacaaggtctttctgcggctgcccccagcctgtcacctgtgtctgtgatgggtctagaacagagtgaggctcaaaaaatagtggctgattagtgcacctgatcagtgaacatgctcagctgattatgaataaataccaaatccatctcatgcagaaaacatggttaccattgcagctaaattcacaagaaacaaatatttgtaccctaaataaagctaagccaaaacttgcactgcttctcccgcagggcttccagttctaggatggtgctacctttccactctgcctgggcttttatcccagagtacttgggtgaccttttctcccttatgaatttctagagctttctcagagtccctatagtttaactaaccttcttctgcaacaagatgttatcatcacaaaatgcgcaggcagttttcatgacagaaatcctatctctttttatggagcatgagagaagtttggcccagctgaatgattttcgaacatttcctcttgtgtgttcttttcctaattagtgtctagtgctcttggtaagaaggaccctcactgcacatttaaatcaccttggtagggaaatgctaccttaggtattgcaccatttcagcaactgcctgagcctgacatttttataccaaactttatagcagcctcagttttcttccctttttctatttcatattcatatataacattttattgttgcaggtatgttctgttgtgggcaggattatgtgaatatgtcagataccatatgctgctcagcttccagtggagagtctaaagcacatattaaaaagaatgacccggtgccagtaaaatgctgtgagactgaacttattccaaagagccagaaatgctgtaatggagttggatataatcctttgaaatatgtttgctctgacaagatttcaactggaatgatgatgaaggtaattgatagaaaagctctcggaggcgctgatttgacaatggaaagagaaatacattgttcataactatttttctaaaataggaatataaaaactcctgtgtgcattattcattttcacattacatccatattaataccgaatgagttcgctatgattgatgttattgcaatgaattctaaaggaattaataatgattagctgttctcagggaagctttacccagcacttcagattagtgcaggactgaaagtctgtgtgccactgaaagagccagcacaggtcgtctggggcctctgcatggtgccatttcatgcctgggagcactgtggatggaggcaggaggaaattcccgcttcttctccctagcccgccagccatcatccaccactttcctttgatagagaccttagatccagcaaattcgcttagttgcatttatatcatattcccttggacaatgcaagatgagcaaatgcctgtgtcaaaagtgaatgaataggcttctgggtgtaatcgcttatgtttttgtatggtgatggtttgtacacagccatgtcatgtatgtgggtattaaacttgacccaggataccagaagcctatcaatttaaggaaaggaccatggacactttaaaaataaacatgctaccgtgttctgtagtaatttgtcattataagaccactaaaaatgggtgtcttggtcacagacaatggaaggacgcttgttcaatgaggcaactacacagtccttgtgtagaccacatacactttgtacactttgggatgtaaaataactcatgagattgttagaagccctgcaagcactttgtatcaatgaatgattaagataacacataaggttggttaaattattctaatgaggacaatatttctccatgctgaatcaagtagtgtgtatacataataatgttcagtctgtaggtttcattttgttttctgaagacctaccacctggagacatttatatcctgttccagtctggaatggatcaccatgggatttttacatagctggcccattcggtcttccctaagctatcaattcaggaattccttttacctctttcctgtgttgattcccctgtttttttgttttgttttgttttgttttgttttgttttggattccaagtttcattccatttggagaattatcttcttgtatatagatgtatggagggtaaattttttaaaagcttaatgtataaaaatactattattttaccctccaacaggattgatagtttggtctgatatacaattccaggttaaaaattatgtctactcagaattttgaggcatttctgcatgttttaagcttccattaatattttgattcctatctctctgttggtaaccatgtttcttttcctatgaaagctcttgaagatgttctctttatcctgctcctctaaaatttcatgacaatgaacctctatgtggaagttaggatggtttctttttgcattttgttttccatttttgtgatgagagcatttaggatctactctcttagcaattttttttttacattacaattcattatgagttaggcagttgtcttccaagtaacatctctagaaccgaagccccttacatcttgtgatgcttcatgcagcccttggatcataatggaaaaggcgcaagaggggacaattgcacacagacagttcctacctggatatagagtacatcctttctatgcactagtcacacagacatatctagtcaggtggcttctcctactgcagccaggtttcaacatcccatgttcccagagagaaaagggaaacatggacatcactgagcacattgcattgtctctgccacattcatctactttccagcttccaaaaaggtatgcactgtcttgtgtgtattatttttctccattttttcttagactttcaacacgtaaaccagtattttactgtcatttagttgggcttttagaggatagatagatagatatagatagatagatacacacacatacacacacacacatatatatatagtgggattctatttatgtagtgtcatcttggctcactgcaacctctacctgctaggttcaagcgattctcctccctcaacctgccaagtagctgggattacaggtgtgcgccaccaagcccagctaatttttgtttttttagtagtgacagggtttcgccatgttgatcggtctggtctcgaaatcctgacctcaagtgatccacccacctccgcctcccaaagtgttgggattatagacatgagccactgcgcccagacccactatatatttttgaatgtactattttgatcaacttggtaagaataattcaacttattttatgtaagagagaggctgaatggagatcaattttaatagcaaaaagtattctaaatacattatgctacttatgtaaaggaaaggcaaagtagatctccacattataaaactattaccttacttatagctcttgtagtgtgggatgattaagtatttaatttccttggattaaaacaaagtggtacttatcaaaaaccataaaaaatctggagatgtgtcagagaaaatgtttataagcgtaaataattataattacaatgacagttcatgaaacatttatatttttaaaaacttggatcagtaatacttctaatgggaccaacttccccaacaacacaggaagtgtaaattctcaaatatcacattctttattttctctaaaattccataggaaagtatcaaatagcaaaaataaaatatttgtagtgtgtatactaagtttaaagacttatcagttttgagtcacacaacaaaccttggtggtaaattatatgatttgagtcacacaacaaaccttggtagtaaattttgtctccatgttccccactgaagaagctgaggttttgaaaacataagtgacttgctcaaggttacagagctgggaagctgcaaaactgaaattttaatcccaatttgtgacatttcaaagtcattgttcttcctagtatacaaactgccttcatttctttttataaattttgaaatattcattcatcaagtaagtggaggaaaaatttcatttgaaagtcacaaaagcctaccctatgtatgtctaaatgaaatttttaaatacccctctctctctcacccctgccacttgactcaggaaaccaaagagtgcaggatcctctgcccagcatctatggaagccacagaacattgtggcaggtgtgacttcaactttaccagccacatttgcactgtgataagagggtctcacaattccacagggaaggcatcaattgaagaaatgtgttcatctgccgaagaaaccattcatacagggagtgtaaacacgtactcttacacaggtaacagaaagcaagctgtctgcccatggcttaatggggttagtgagaagctgctgaaaatgcagatttatttcactctgacatcaactctccttaaactgatatcagtacattccatcatactttgaggccagctagttacaaggtaattaaaggcataatctggatgtattcaaagtcagtactttaaaatgtgttaaagtctatttaaacaaggttgtattccatattaaggtaaatctgtggagatatctgtgacctttactgctatatccagttaatttacaataaatccaatttcctttttcaaaagctgcaatgcagcttccactgaatgcattgaatgaatactgctatactcttaagcagaaagaaggatgaacctgtctgattaataataaaacctaacagtgctactctgaggatgaggtaaacccaagcatgacatttctccaagatggctggtcatctccaaaagaataacctttgcagttattgtaaatattaatttctatgtaccatcttggccctgctgaattagtccaaaatggttatgcttagttttggctgagctgtgtgagaaacactgttaagtttagaattatctctaaaacagttctgccatcaattaaatttgtgttattcatccatttacttaagtccctacaaaatgtgttcttgttttttgaaaaatcaagtttgtgtgtgtgtgtgtgtgtgtgtgtgtgtgtgtgtgtatcatctatcatcttgattcaatagaatccatttaagtgacataatttgagcaagctaaggttaataaacaagcaaaacattgctccattccatcatgaatcatcagtctgctttactcaaccaaggggcaataatggctaacctcaagagtgcagaaagtaaggcaggctactaagataagaggaggaagattaggaagggaagaaaggaacagagataaggttgattgaacattatttagtctcaatgttatactaggtactttaatttttttattatactttaagttctagggtacatgtgcacaacgtgcaggtttgttacatgtatacatgtgccatgttggtgtgctgcacccattaacttgtcatttacattaggtatatctctacactaggtactttaaaaccttatctcagttaccaacaaagcaatcatataaatatggtcatttaacagatgaggaaactgagggtcagatctgtaaaagttactcgccatgagaaagaaacatattcaaataatgccatcatcaaaagggacagactttgaagactccacgtggtgcaggagctcctttcagagtgctccaaatgcacttcaagctgttattccacctgaaatgtcctcctttatcatcctactcaaggcctaggtcaagattcttttcctcaatgcagtccctgtgctgctatggcacattgttcacaaagctcactagctctctcatgtgtcatatggatttggacacttgttccagctcttctattagattgaaacatccttatgaatagggcatttttgtttacctttgcctcgttatttggatttagaacactatacaaacaaaaaatatttcttggaatgaatttaattaggaaaggcctcagatagaggacaatttgtccaaccttctattgtgttcccagtcccagttatagatttaagtcatggactttcatttttaaattattgagtttccatctaagagagttctctacttttatctgccccttgtaatcaagatcaagattttgaagggcttttaataaatacttgtaatagccctctccagaagtgaatagatgtttccacctactgatataatgttatgagggcttttaaaatccatatttcagattgctttgcctgcagaaaatactacaaattgaatatgaaaaataacaaactgttctttttcatgaaagatgttcagcacacaagtggtgctatgataattccattgagaacaatttagattaagtcagactcttttagaaacttacacttgaaagctgacaataccagtgctgacaaaaatttattcatttatgcaatcatttatttatcaaaaattatttattaaatacctactaataactagtcactacattaggactagcagctatgatgacaaacaataatttttcattgagatttcaaccctatatgaagaaagaaggaagcagcaaatgagatttgaaatggtaatgtgggcttgaggatacagaataacagtcattaccaataagtagtttaatttgctgtagcagaaatgtaaaacatattgaccatctgagggtaggtagatggtctaggcaactgaatcgcacaaggtcattcaggtatccagaatccagaatggcaaccgaaggtatgcaattttctctttataaaatgatgtggaagttgtcagtgtctttctatactccttcaagtattgagatctgagtcatgtgaccactagaagctacaaagaaaactggcaaatgtggttttctaagcaggaggcctctgaccaggatggaagggagaactggggactcatggttgccatcacaggcaacaagtggcagatacccccgagcagaaaaaaatggaaaaggaagataatgctttacatttgtagagcaatctgcattttatgaagttctgccccataatttattgcattgtattttcatattagttctatacagtgggcagggaagggtttattgtaaggagatgtatataaggagaatgtctctccattaatctaagcatagagactgagaattaactccacgtccaatggagatgagcaggtggccaggcagccaaggaggaaggcctccttttctgatgctcaatctgagaaagagtcatccagaagctaacacacaaaaatacatacatacttacttaaaattcatcaaattagagacatggaaaataaatttaaataattaaactttcaagtaagtttttcaggggaaatgtgtagcattggtatttccgaagttattaaagcctaaatggaactaagactttggggacacaactgaatcacatgagtgttcatctaatacaatttttgccagtttggaaagctcagcaggcttggttttattgttttaataaagttggttggtttgtattttggttttcagttctggcttttgtggaagagggaaggaactagatagcagagtatgctttcatttttattcactaacatggtaccatgataaactaagtttcaaatcctgtatattgtaacaacattataatccatatgatttaaaattttttaagtaatattaacaaagtaacagaaagcaataatttataagttctatgatactaaaactataaaagaatgttgccaaacctgtctcatgtaggaatcaaaactacatgaatttgtgaagcactaaatcttattatacatgattccagtgcttttatttttcatttatttaatatatccctctttctctgctcagaaacagggaattctattctgtgcaattccgtatccctgcatctaataaatactttaaatgttacttatatttagaaaataaagatattagagttttatttatatacaaagcgtttagagcattaaacatttatttttaaatgtctaaagtttttgatattcacttttaatatgatggttaaaaaatgaaaataagagaaacttccctgtctattttttctctttccagatgtgaacctcaagccctacatgacatatgagtacaggatttctgcctggaacagctatgggcgaggactcagcaaagctgtgagagccagaacaaaagaagatgtgcctcaaggagtgagtccccctacgtggaccaaaatagacaatcttgaagatacaattgtcttaaactggagaaaacctatacaatcaaatggtattgagatacctttaaaatacaaataacaaaatcccataaattcataagaaaattgaaatgagtacaatctacatttaattgccctatgcatctaaccactagaaaagtatgttccgataaagggaactgtaattatgtgacaactaatcactcactttgtggtgtagtcctcgtagatttttagcctaaataagtaaaaaaatagaaatgaaagttccttgaatcccagaatatatctgagctgctttcaaaacaagcaaggcatattcagagaaggggaaagagttttaatattgaaagtaaatttgtttcatagtgaaaggaaataaacataaatgactcttatcatttatgtcaagaatccatctcctccataatagtataattaggaactgcttgagacagcaatataataggaaattaaaattaaataaagctatagtattgcatttcttccgaacactaagatttgtaagttgtttgcaaatagttaaaatgatatcacattcaaatgcagtcatttttctgcttcttttaggtcctattatttactacatccttcttcgaaatggaattgaacgttttcggggaacatcactgagcttctctgataaagagggaattcaaccatttcaggaatattcatatcagctgaaagcttgcacggttgctggctgtgccaccagtagcaaggtaagaggagtttgcctaaactctgggaaaaggggttcagtgtgaagattatctgaacatccaggttgtgactgcttttttcattgaagaaaacaatgtccctcctcaaagtggtgttaagtagcgtgttcatgtgtcacgttaactgagtgctaatacctatggctggaaggagagatcatttcaagggagatttatccaaatatcaatcttgtgttaatgaaaaacaagtgaaatcttgaagcagtaccatcttttcttccacattctttcctcaccaaccaattttaggtaatctataaatctataaaaatgtccaaatcattattcagttaaagaaagtttctatttaaatatgatatgaacaaaaattgtctgattttaaaaaatgaagagaagggcaaaaaagcctggcacggaaaacaaaattgttccaagccttctgctatagccttgtcaagaaataatgaagacctgaatttaggcagcagaggtcagaaccgagaatacagaatgatacaacagacatgggggataaaatctacaaaacttggtactcaattatatttacagaaataaaaggaaagagtcacggatattgtcaaatatctgcttgagtaatttgtggatcatggtgctattctgcaagcaaatttttaaaaaagagaaaaatgttgaaggtaaaagaataggattctgttttgttaagttttgtaaaaaatatatttaaagagaaggatcagatagcagggtggcggaagcagatagtacttggcactttatgtgaaaatatctggtcagaaaccagattgagaggtgactgaagtttctagaaagatctgtatgggaagttgaagtaatgagtataaatatggacatggaaggagaatagagagaaacaaatatggaatattgtggatgatgagcactggggaatgctaccaaatgaaaaagaaagaaaagcccacaaagaagactggaaataaacaatcaaacaatgtgggagtaaaataaagaaagggacatttcatagaagccagccttgacagaggaagcccaggaggaaacaaacttacacagagtagctctgattcttttcatatgcttaaaactttagaagagcaacatctttgcacactgtgcaagagccatccaaatgaaacattcagccacactgctcagccacagtgcaagaatgcaacattttgttcaacagacttctggaaacctttctgagtgagccaccatttagatagatagatggcagctgattggcccagtcaaaagttattagtcctagaacaattccatgctttttgcataggcacacttcatgcctgctacatgcaaagcaattgtttacaaagtgaaaaaagttaattctatgaaagaagccaatttttgtccaaaactatgttttgacaatattgactaagtaattgatttatttttttcttctgacttgtttctttctttagaaagttggtgcagacactataaagtcatcctaggtatcatgggaagagtaccgaaatgtctgcccatttattctgttcaaagcatattgtatgcaagcaagttcagatgtggcttttgctccatatttactggtgcttaaaatgtatgaaatcaggctgttaaaatgcaaagacactgatgggccatatggaagagagttatcaagagttctctagtaagacagtctgccagccagattttacttgtttaaacactgagggctgcactctgccgtcaaaattgttgttgaacctgttgtgataaatggtagtgtgagacttatgtaatatattcaaggtcagatttcattgtttaaataggttgggagggaaaaaaatgaaaaaaaagggaaatgcttctccaagcccctgctaatgatatgccaggccagacaacattttaaaacaaaagtgacattctcattgatcaggatagctagtgcactattacaataaattgctgcttaattcctacgtcttcaggtagttgcagctactacccaaggagttccggagagcatcctgccaccaagcatcacagccctaagtgcagtggctctgcatctgagctggagtgtccctgagaaatcaaacggcgtcattaaagagtaccagatcaggcaggttgggaaaggtctcatccacactgacaccactgacaggagacagcatacggtcacaggtgagaaaacaaaaaaaaaggaaatcctactggaggagtctgtcattgtggttaggggggcaaagcatcccaggggtgtgtgtttgatatatgaggtcacttcgaaaggacgtgttctcttgacatatggtcaggtcccacttatccatgctaatagaagagcccacactggcagcaatacgccacaacagcagataacttcagaaataatttatatttggccttgatatgcattatgtgaagggtttttgcatcagtattaactttttttttcaaacaaacagtaagatgcattttcattccccaaggatatactcatagttaatgggactaagatagccaagaatatactggaaggcaggggaaaatcagccagaggttaacatttgtctatcaagtggataattaatacacaggactagttgacagtggagtcattgtgactgtttgttactattaggaatgttaattaatagcaattgtgtttttttaatttattataatgtttattatcattagccttaataatatactattagtacagtacaatgatatgttagataattgctagtagtgattatgataataattaacaggttttagcttaaatgccacttctgaagggaggagaagcattttctgacttacttgctcgaataggttctctaacacaccaccacatcactttgttttatttccatcatagacctctcactgcctgatattttagtgtttgttttttgtctttttatgtctctccacacttgaatgtaggctccaagagagcaggaaccttatctacttgttcagtgttgtacctctagcacttatagtcctgaacacattaataggagctaaataaacgtttggggaagaagggaacttaatatgtgccagacgctgtcctaagcactttgagtgcactatgcaatttgattctccatcaccaacctaagatgtacagtgaattactaccttcattttacagaaaagaatactttgagaagttaagtaatttagttcattattcgagtctactgaatcatcccaaacaaccctgttaagtttaaattctaagaccatgggcaagattgtataaactttcccttttttcccattgtcagccacctccttccaagacttcctgagtggatgacctccttccattggactgcactttttgcagggggtgttgatagcacagataatgaaactcacagaaaagtgcagaaaggccttggaaaaatgtgactgatttttcctaagaagggacacaggttacacttacacagggtggcaaaataaattcatcacttttcactcttaaatgccacaattccctaacacataagcaagcattcattgacaaaatctccagtatttttccaaaagggccgtaaacctgcagaaggtgcttaatacaactcttggcctggcacattgtattccttacctcaagatcctgggctaaatcaatgatgatagtgttgaggctgggtgcggtggctcatgcctgtaatctcagcactttgggacgccgaggcagccggatcacctgaggtcaggagttcgagaccagcctggccaacatggcaaaacctcgtctctactaaaaatacaaaaatcagttgggcatggtggtgtgcatctgtaatcccagctactctggaggctgaggtaggggaatcactccaacctgggcggcagaggttgcagtgagctgagattacaccagtgcactccagcctgggcaacagaacgagactctgtctcaaaaaaaaaaaaaagataatggggttgggagaagccctcatatttgaatgatcaaaattatttcttttatcttattttacttgaagtggaaatcatcacaagtgattgaaataatggtgttttacataataaaaccttacttctatgtggtgctttatcatttaaagaaacgtttgcattttgacttctctgactctcatcacatccttgtaagagatgtttttaataatcatatctgaaagatgaagaagaaagccaacctactcagcgtatccaaggcattcactgcctgtatctgaaaggaaatcagaatatcatttcgttctcccaaaaatgaattgccagcttgcagttttccagatagtacactaagtggtctaaaataagactgctgctcttaagatcctctcacgtacagggaagactgacaagaaaagaaataactgaaaacagagctctatacaggatgcagtggtgaaaaatcaaatgagtcacttggagtaagcaatgggatgttaattacagggttttgaaaagcaagtttaggcacattaagactgtaccagcaaaggtttcacaataattgtgatataaggctaaagaaatttcttcttgtagtatctatcaacttaaccagcatcagcttcgaattgttgctactttattggtttgcattttttagaaatcagcatttatacaccaacagaccaaattcaattgtaatgttcaaaccaacaggattgatagcctcattaattataaaataattgcaaagatttttctctaaataacttcaccctaccagttcttcctttcattgacatttttaatggctatttttatgtcagagtagatttcatacatgtatcttggtgccagaaatcctattattagcataaatattttaaggttttttaatataattttaatttttacttaacagtaaaaaatcataatctggtaaaagcctttaggagtcctttgaccaatctccctgttctacttttgatttgttttaatttctatggatattgttttaaatagatttagagagtatttcacttgcccaatacagccctaaagaggggtttctttgtagaataaagaaataagtcctcattcagcaaaaccttaccaagtacagagcctcctatatgtagttctttggggacaggaatggtgctaggcattagataatcggaaacttgagatctatataatgttactcatttgcccaggaaaattcagttccacggttagctgactgaccaaatgtagtactgaagtattttatggtgtgaatgactgttttattgagttcatggaatgaactaaaataatcaaatttattttctgttccatcttaaatgtttgatggaaatgctgcctgaaccccctaggataaatgttttgattttctcatcatttccaaaagcttggcattccctaagcaacacagcactaataaagctgtagcactagtcgtcctggagcctgaaaatctaggtccttaggaatgacaggagggaaagggagcaccttgcctcggccccattgtctccatgcttatttttaattacctcaaagctttagaaacatgatcccgtaaatgctttgtgggaatagtggcgaatgcactcatcatgtgaaatccataaattgcttataatcctctcaagatgttaaaaaaagcattaagtaattgaagacaggaagtcctcggttaattatttagaggtgttatcaatgctttaagtaaactgaagcgttttctgctatctcactgagctgaataccatggggacgaaggagtagcagccatcatcttctcatattcgctaatgcaaacagcgcatggcagcttgtcaataaaagaccttttcatatcatttattactaaacacatccaccatcctgtacagaacaatttggacatcagttatggcattgtttcactttgggctacctctacattatacgtaggcctcctaatgtgagtttaggaatagaagaaaggattaactaaataattaaggccactgagaaaaaaatgaattagtcatgtcctgtttagcataacgtataataagggcctatgtgtctcttactctggaaaactattttcaaaataattaattagaaattactcatcattgcatttcatttaaaaggaaaaactcaccagcattaaattagcaaggaaagaataatttactttcgtttctcatcttcctagaagttaatgaaaactttgtgtgctaaatagaacaaaccctaacaatgctggttgtagcagaaaatgtaatactaatgttatactgaaacagataccttacacttcaccttggaaaaagagaaaacatactttaaccaccaatacaacaaaatgtagaaattctttgtaagggattttatttttagataactctgctatgtgttcccatattatctttgctctcgtagtaattatcacattttattctaatagcctttcctcttgtctctgttccacacttagtaataggtaatgctttttaagtacagagacagtagcttcctgtttgccattgtgttcctggtacctatcacagtacttaatatattcaaaaaatgtttgtcgaatgaataaatactgaatagtaaactagtatttgactacattctgttttgaatggagataaaaatgccactgtcaaacgtatctaaatcgcagacagatctggcaacaaaattgtggggtccagtgcgaaatgaaaattcaggccccttgttcagaaatcattaaaatttcaagacaatggaagcagagcatagaagtaagctcatgtgcttccaagcatggtaccgtgtttgattgcacagtcgaagcccacaaagccaaccctgatctccagcagtctggaattagctgcagtatatttctttaattaaaacagatagcaagaaaactaggatggtgataatgtcctcaaaaagctttgggagtttcttctatggttgtttgcaatgctccaggctgcattccccccagttactatgtaattactgaccaccaagcactggggacctgtgaaaatagagataagaatttgttttcttttcattttttcaactctgagaacaactaaatttgtgcctgaccaaaaaagtaaaaaaaaaaaagaaaaaaaaaagtgtggcatcaaccacttttttgtgttttaaaacctgcctattgataaaatattaaggccaaagaactataattgatagctgcctagacaatgatattttttaaaattccccttaaatcccagatattccaatgtactttgccagatactagttctgttttgtcactccagttctggccacccccttccctctgcaatgtcctcattgtctcacgtttgagcaacatcagattttgctgccacctgacatcacattttgtttttagagaagaaaagtctgcctggaaatgcagagaagaatcctcagtctagcataacactgaacttgaaagaggaaaagtatttattaaaatatttattaaaatactgtcactaaaatcaaaatatatatatcacagatataattcatattatatttttgttgttatatttattccagatatacatcaacattaagactattatttagacaccaccaaagaaaaagggtctttccttggtggtgtctaaataatagtcttaatgctgatgtatatctaaagagagtctgccaaagaagtaacttgtttaggaaaggcgtcttgggatcaggaagatattggagagaggggcctaagctatggcccagaatttcaaatgaaatatagaattaataacgcaagttagcttatagcaagtagtcagaactaaaagtcatgaagtgatcttactggcatgtgcaatgcaagagtccctttgttttgatgttttgatgttcagttcatatgaggtagcaactgaattcataaagcatgaatacagaaaatggacagtacaaatgctgctcaatgggggggaggaaattggcttgggtaagtggaatgggcagctgttgagattgtgaagaatgataccatccagaaaagatggctttagcatgtgaactcccgaaataatccttaatcaaatcctgtaaaacaaattctaatttaaaggtaccttagatgtctgtaaagtaattccatgatgcctttgtataccagttttgaacatctggattttcacagattgtcagattgatctaagtagaatgctgatatggctctatccatcacagtcaagatcaccaggggatgctggaagttcctgggaatctcagtaggcagagatgctccgaaagggatcacttagtgagatcccaggcaagtgagggcaaaaggaagcaacatcattatagttgtctgggtatatactctggggctcgttgtcttgcgccaagaaagaattcaggacacagacacatgtgggtgtgttaaggagtggaaagtttaatagaagaaaggagagaggagagcagctccttgtgagagagagagagaaagacagagagagagagagagagagacagagagagagagagagagacagagagacagagagacatccgtaaagtggggaggcagcggaccaaagcagattttacaggcaggctggagaaggcagtgtctgatttatatagggctcacagattggttcgatcaagtatgacatttacatagtgggaggggaaggctggtcaccccaccctaatcttattatgcaaatgggccttccagttgattggttccatcttgtctgagccttacagtacaagtggctgacaaggagaagggaagatggagcctccatcttgaacatgtacagtccttagttcctgcccacattcacccatgcaagcacccagcttgtttacctatgtctgcagctcgattttacatgcttgccctttgttagaaaattatttggggctttttactaaaaagaaaaggcttaccgaggactcccatacctttactatctgcctaagtgatttcttcttaactcctgtatcattagcaaggactgaatgtgagcagccgaggggccagaccacacatccagtttgggtgaactggtgccaggacagatgacttacccgcaggatggttattcacaatactttataagcaccaaacaaaaactttttaacgtaactcaggcctctcagtgcttgagctaatcactaaacatgctgatggaggaactcactgaattacacatcctttaggactatttggtaattctttagaacatagcagatgacactatagaataattggctgaatgttttgaagtagcacttgctatgtgaaattataatggctaaagtgcctttttttgactatttatcaagagattaaaaattggaagcaagctgttctttatagagtacatcaaatgttaactttcatagacatgggttttgttttccaaatcatatttttatgaactaaaggcagactttttgcagtcccttttagcacacatttactcttcaaagtaatgttacttggaagtgtaattgtaatgagtttggttatattatgcttctttcctttaaaaaagaacatgattccctgtagggaaattcaggtaatttgcagccacagtaatcttcactatactgaaatgttaaatacttggcttttctccatgtgtttgcctttctgtactctacaagtgctatttcctactcttctaattcaatgctgagcacttgaatgatgttttcttttctccttctactcttcgacttcaggattaagttacagttggaatggttcctttgagacatctctttatttccctcttctcatcctgatcaattcatgagtagttttcaattggtgtgccctttttattgcctgttgctagtatgtcatatatatctcattttaaggactaccgatagaggcttacttaaaatgacagcaaattccagttgaaatgtgttcattttattgagttttacagagtcgtatatatgaaaggtcatcaggttcatgtaaatcatctatgcctgatggtagttgatgctttcttacagattatctgaaccaagcctattagtaatccagtcctctaacaatatgaaaaatataaaaactaaaagatagaatatggttttaaattttctaaattatggatttagatattgccttcccttaaattaatctgtaggcctattaagcagtctctactatcatgcctacagtttatagatatagaaactgaggaacctagaagccagaaaacttccttgtagtctagtacttggtaagtagataagtattagaacccaaatagtctaatttcagactgctctcttagcacagaacatgactcagtatctcactacatgactcataataatattcaaaatgaaaatatttaaatatatagtcccacttgaatttttttttttttttttttttttttttttttttttttttttttttgagacggagtctcgctctgtcgcccaggctggagtgcagtggcgggatctcggctcactgcaagctccgcctcctgggttcacgccattctcctgcctcagcctcccaagtagctgggactgcaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccactgcgcccggccgaattttttatattactggaaatttgactgggctttgagctatttatgtcatcgtttttgttataaggctgggaagcctaacccagttgctctgggccacatttctcagtgtaattgcccaagttccaaccttggcctcaccctttccttttctttctttctttttttttttaggcagtctagctactatgtcacccaggctggagcatagtggcaggatctcagctcactgcaacctctgcctcccaggttcaagcaattctccagcatcagcctcccaaacagctgggactacaggcatgcaccaccacgcctggctaatttttgtaggtttttttttttttttttttttttttagtagagacggggtttcactatgttggccaggttggtctcaaactcctgacctcaagtgatccacccgcctcgtcctcccaaagtgctgggactagaggcatgagccaccgtaccaccggtcccggccctttcttatgtctgtgatcataggtactttcctccaactttctgtgccttagcttccttatctgtataatgaacaaataatagcgtgcacagcagaaagttagtgtgggcgttaattatattaacacccatgaagtgcacagaagagggccaactagtagtacatgctcaataaacttttgctagtatgtcatttacataatcttataactaacttccttgaaaataactgcaattctcataaaatatatttagataatgtatagagtccaatgaaaagagaattaaaaacagaccaacaaaaacaaaaacaccctgagttttgtctgttgggtattttttttcttaatttatagtttttgtgctggtgtttgaactacattcttttaacttttttttttcgttttgagcaactacagtgtatacaattatgacttgccaattaaaataatattaattttaataaagagcagctgcaatggtttctaccatttttatgtcttctaaatgctgcttaatcttcagagggaaggcagccattgagtaacttaaatactgttagctctagctcttatgtgatggagaacatagagcttggtattcaggcttgggtcatctatgcactcctcagtccaggtgaagtcaacgctaaataaagtacaaagcctgatagtggacaaatgactggcttatccaaggaaaatgtgagttttgttataaaaagcaggaacagaccctggaaggtaaatatggcagatgtgaagttgcttgacacacattagcaaacatcatttgaaatgagcctaagtattactaccctttgcccacatggtccattaaactggtcagcatggctacatttcagggacagacacagctcttgaggataaagtgccaatgaattagagtaaaactgtcattctccccatattcacttgcagacatgtctcccactctcatcctcctggttcttcaatctttgtctcctttcctcagtgcaccatgttgactcctcttgatttgataatatgtttgaactcctctgacttcttgacgaaggttttctgctcagtgctgagtctgccattcctccttgattctagtaccccagtagcttcaagagaagcaaattccttccaccagccctacccccatatcctgctaggtgaacctatcccatctaatgtaaacacctgtagcaaactcctttgatgcactttcctccctctatcaaaaatccttaaggtgctggatgctctactgctgtaccatgcctaaacacctgccttctcaaattctaggctgtaagtaaaatggagaccactcaacttgcagcagaaaggctttgtcaagaaatgacaatttatatttttatatacattaattttcctttcagctacgattctcattacaaatacgcttaatcctctaatcaaccttagcaaacctctgtgattatgaattttcttttttccctaatgcccatcctaaaattttatttaacagtcactgcatgtctgaaatcagaccagccacgaccacaatgaggaagataactgaggccattgttttgctcagaatattcgagaaaaaaatttaaatatctgtttacttttagctaccatatttacatctggcattcaggaaaaaatctagaatatgtgtattgcccacaaattatattagtttctgttattttattaatattctgcaactaaaaaatatctccaactcaatgaaatcattgctgtggacagggataccgatggaattatgaggaaggacctttttggtcaggtcacatggtgataaacatcgtagcctcatatccctgcaatccttatgggacactatgatgggcatgctcttctttaagcaatatttgttcaacattgaatgcctaaaaatgggcactataggggaaagtgacctcccaaaaagactcgctcagtgatgccatttctactctcaaagggcttatattctaaatggggaaaataagatattcaggtaaaatggtatcacactggtcaagacccctttttgtcggtaaagagaatgaaggggagacattgtcgagctaaacgagtttgccactgcaacctctgagtttcattcttgaatgttcccttccattattttgagctttacattttgtaatcatagcattttccgatgagcttttatcaaacatatgtggcttgggtacggcttagatctttagtcatattcttcatctgtaaatcaggtaaatatcaaaattatgtaaatcctccaaagcaaccaaatggaagattgtaatcaaataagtgcctgcatcttatcactaagttgataaaaaaaatacaaagggctctgaagctaaaccttggagcagctccagctgcagaacattattgctttagcagagaacccagactactgctctcattctaaatggatgagatgggtaattttttcattcgtttaacgaacacacactttgtgcctgtcacaatcctaaggatacagataggcaaaacaaagttgttgttctttcagagcatacatctaaagcaggagacaaatatcaaataagcaagagacacagcaaacatcagagacggttgaaggctctgaaataagaaaattatgtgaggggataaaaagggatgggtggattgtttagataaagtggtcaaaattttttaaaatgtagtatttgaggagaaatctgcataaatagacaaagtgacacattaacatctctgaaggaacagtcattccaccaaaagaacaaaatatgcgaaaatgtagctcaaaatacgtgaaaaaataagcataacaatcattggattcatctgtaacttagttcaattatttaacaaataggctcagtcctgttgttttaaaatactatttttttctcaaagagagctttggcattgtttgaactttcccaagagtcaagagagagatgtcttgtaagcctcaatatcctccttgttgaatgctgctgagctttaaagttgcttctgctagaatgaaatactactttgagtatcctatttcatcttctcttgtctgctagatgctataatgattccccattttacagatcagtagaccaaggcaaagagaagctaagtaactctaacaaggtcaccagccacgcacagagcagcgaaatctaacaatatacaacttctattttagatggattgtcattcttttctccctgaaaacttactgaacaattaccatactgcatcatattctgaatacgaaagaagtaataagcaccatctcttctccaaattagctttaatctatgtgtaaagacaaaatcaacacacctcaaaaaagggcgcattagatacagtgcaaggtttaaaaacaaaagtgttggttagcgttaatatgagttgaatatggcttggggcaagaaaatgttggatctaaccttctttttattttcctgcccgtatttatataagaagcaattgcagagactgggatggttagcctggagaagagaagactcaggggggatttgataactgtctacaaacatttgaagagctgtcatgtggaaaagaaattagatttgttctatatgtccccaggggtgaaagtgatagaaagatttcatcacaatataaggaaggactttcaaacaaaataaggataactctaaggctctctaaagatgtaatgggctctttgagagacggagtgctctgatccgataggcaggacagccttttcaatgacatcttgtatagggaatcaagagaagggtggatggttcacatgaattttaaggtcttttctatggctgagaatttattagtttatcagtgataaatgaaattttgcccaatacttagcctcttatgaggttcagaccttctttaaagagtgttttagagagtactcttaaatgttttggctatcatatctacaactctgcatgttacttctggtacttaattgataataaataatcctcttaaggtgcactttatttcttgcttgctttttctaggtctccagccatacaccaactacagcttcactcttacagcttgtacatctgctgggtgcacttcaagcgagccttttctaggtcagacactgcaggcagctcctgaaggtaatgaaacaatatccatggtttgagggaagaaattttcacatagcattttgaggtggaatctgtaaactccttcataacaaataaggaagaggcaataaagttgataggtacaaaataaaatagcattctaggttcccattcttcaggcttgattcatgtaggtgtagcttcccaaggtcagttcgctttcaattctttaacctttatagagttgattttctgtggaaagaagaattattgaaatttttcaaaaactcagatgttaaatattttgggagcatctaatatataataagcaccatgctcactgctgaagttgtttaaaatgttctctgccctcaagactgacaatcaagtagaagtgataggagaaagatctgtatgaagagagaaaatctgaaagttgatgttaagaaagaacaaatgaatagagtgctaaggttggcctgaagaggaagagatagaaacccatcgatgacatcaaaaaaggctttatggagcagatgacttctgagatggaccacaacaaacaaggattttgacaaatgaacagtgatgtacagagatgtacaaccagacacagttggaaggaatgtaagatggaatcatcaccttagaaggcaaattgcaaatgtctatcacatttaaattgttaatttcccatgatacagctgttctattttcatcatttatgccagaaactgtgccacactgctcaaggaggcatgcaccaggatgtttattgaagcatttattttgtttaatagcaaaatgttgggagcaattttaatgtttgtgagtagaattgctaaataaattcagctattctcatattgtggaattccatgcaccagtataaaagaatgagatgatcagttcatacaaagaggaagttatgacattatattaatttataagaacaaactgagaaaatggcatttattgttaatggttaataaataaatgcatttaaaaatccaggaagtatacacaccaactgatagcaatggttacccatgtgttcagaggtgggatggctggtgtcatttactttcaaaagaaaaatatactcagtggcatgtgttagtgatcaactaattattttgttaatcttcattatctgcctatttttcatatggggaaaccaaggcataaataagtttctaaacagaaatgcaatgttaattaccaccatagactcctgaactacttgtccattactcttctaatgaaatggattgttgtacctcggaatattagacctgaacttcctaccagtaaatggggaataaaatggaaaattccacatatggggcatatggctcctcaccaggaattcactaatgatgttttctatataaagaatgtttcatgtcaaaaagcttagtgttcctttgaaaggaagaaaccagcagtggattttttggaaaggtaaactatcaaatggatactttgatgataatggataatttctaaaggatctatcaaccagatttggctgaaactcaacctgataaaataacagaatctcttgttccatttctctctaccaaattcatatatttaaattcattggaaatatgaaattttcccaacaaaatttcttgaaatgacttacattttatgacttaaaaattgtagctttcaacagtgcagggtaatgtgatatgagaaatgcccttgatttcttttttttttttaactttatgtatctttcctctaacacaaataatcatgcaaagaaataatagatgaaatggactttcctctgcagaagaaacatggatttagggccattttctggctgaataagtgccatttatatataacccatatatgaaataaatatagtgtgaatgcttaacttgggaacaccttagcaatcacattaagttctgttgttttactgtaaagtgaaaacaagtataccactttagattatccacccagacataactaattataaaatgccattttcgaagtacatcagatataatttgaagatctcatatttgagtattttaagtggacatggaaagaattaaaagaagtgtttatgcatagccaacgcaagctgagctcttttcacttgcctctcattttcaatctaagaaaaagtcaatgtacattacaacctcattgacaagttggacacagttctctacagttttatcctcatagaaaactgtgtacctgtacctttagtcaaataacaggaagattttgaattgaattattactctttttttctacaattactgccatccatgtgagttctaattcattttagagataaatcatgcaaaattgcagacatactttcctctagcattgataatgtggaaacagaaaggaaaagaagacccagtctttttcagttcattccagattcctcttcctctgcccttcttttaacgtttacacacccttggttttttcctctactctttacactatagcacccaggctcttctggaattttcgagtactggctttatctcctaatgaaggctgagagctaccaaatactaaagctctcaccaaagctacacttatggatttaaatcctatgtatttactggtctactacatgtttatatttaggtgtttttcaaaaactttaacctcagtacttcgccacttaattcttccactccactctactcctcaacttgcttttcttctctcaaatactaccacctacctatcacctaagcccaaagcttgacactcttgatggctcccttttccatatgtaatacataattttttataaaatctaattagttttaaatcttaagaattttttttaaaaaaattgttcttctttcccgtcccttttaacactgccttagttcagatcctcatagctataagaagagaagttctctggatcctcctaactaggatcccttcctctagtcatttttcctctttctcacatcccacatcctgattctttttcctcttttgacaaaataagaatatgtcatattattcacctccataaagtcccatttccttccaggaagacatacatccatatctccttagcaaagcaacatggacccctcaagttttaacttccatcaatttttcaaggctttccatcttccccacatgccatgcagtgcaccagccatgccaaggtatgtgcagtcctgccatccttgcccacatttctacgactttatgtgggttcccctcagcctgaactccctttccctacatcctcactcagttaacgctcaccttttcaaaacttggttcacgcatctccccttctggaaatcttccactacaaccacctacttcctacccatctccacttctccccacagtctgtgtcaggttaccctttctaagtgttctaacagctactgtgcctccttctcttaaagcatgtatcatactggagtacaactttttatcgactcatctttattcaccatgatacatgaactccatgaaggataagaaaaagtctttatcttcccatccacagtgcccaacacagaaaatgacacaaagtcgggtagaatgttgagtgaataaattaacaaatactaaattgtccagaattcagtgcatccctgacatcagctaatacaaaatttgttcctatcaccagatttcaggagaaaaacaatccacaataaatgctgggaattttgaattggaatgaagatttgtagggacatgagaagtgggtaatatggcatgcaactcaagataaatttaaaacaaatacagtagacatgttctacttgttgtcactgtgtaaaaaggcccaccaaggtttaattctacctttccccttttaaccttgcagctagtttaccccaccccatcctcctaggttacttccctccctactattcatttctttcacttgaactgcctcagtttgctcccttattatatagaataggtttttctggtttcacctgagacttaggccagagttacatggtgaaggggacaaattccccacctcggactcattaatatatctcaccaaagattgtcttactctagcaaagatttcttgcagctgccaagataacgatgtccccatatcaccatccaagtaaaaatgcagcactttctagttatatatacatttgaactccatattatcaatcaaaccaatgggcatggagttattaccaacttgaaaagagcttttgccagccggtataaataataaactcaacttttacctaaaggttgaaacaaacccaaaattatgtttcattttattttattagctcctccacatccacaggctttattgactggttcaaatcagaaaccaagcaatagccattctagtaccttggtgatttttaatacatcgttcaaggtgaaaaagatataactgcaggaagcagattatgaattaagattttatactttatcttttgaatcaacaaattaatatcacatttaaatcaaaactctgattggttgaatcatctagcagctgttggcagagaaacccacatacaaatgtgtactatgatttgtgaattttaccaaatatctagaacagagcagactctcagaacaaaatgaactactttcttctcaggaatatattgctccttagaaagttgggatgtttgagacatttttgaaatctatcttgtttctttcaggatgctgctaaataaattgcattttgttcttctgaaaatttttcttctaaaagtgtcaaaatcttaacctgtacggagtaacttacacaggagatacaatcaagcaaaagctattgattacagggaacctaatattgaaatgagttttttttaatctccagaagagatttacagtgtctaatcagagtataactagatgacaacataaagtggtaggactgaactttctcactgctggcttctccatcgatggatttgtacatctataagagtacttgaatgtttgacattgaattacagttgtttgtgtgtatattttattttttagacagaagtataaactccttgaaagtgagccacatcttagtcatctttgcattccctagaactgcctgcagtgcttagcataacattttgcaggagatatatttacaataaatctactcattaaacatgtattaggcattgtgttatccatagagatacattgacgaataagacagagaagatccctgctaccatggaactaactttgcatcaaagtaagagaaaggagaggactgcaccatcatataatgtaaaaataatagtatgtcaaagaaagaatttgattatgatgtcttgagtgttaagaaggaaatagaaaaggccatgcgatacagagaaactaggttgggactccattagatggggttcaagttagagttaagagagtgctaaaatgaggccttatcaataaggtgatagttacacaagtaactgaactatgagaacatatgagaacattctacatataagaacaattctacatatgagaacaaaatgcaaaaatgtcatgctgtaagggaacaaaggtgttccaggccaaaggaaccgaagttcaaaagcccaggtgtaggaaataactagaagcattctagggatagaaaggaatctggtatggccacagctctgtgaatggtgcaaagaatgctgccacttaggccagagccaataaaatgtgggaccatatgggtcacaaaaagaaattgggattatattatatgaataaattcaaaagggttatatggttcataaagatgacactggcttacatattcactttatacacttttacaaagattccaatggaatatggaaggccaagatttcgacatggaggcaagtttagaagctatgacaggagtttatgagagagagaaacgtggcttggaccaggagaagtgaaagtaaagatacaggaaagtatacattatagaatcttctgggctttatgttagattacatttgggcgtatgaaaggtgaaagtctcagggatcattatttttgtgtgttttgtccaagaaaatggatagatggacaagattgggaggtacatagattgtagacaggaaaaacaagagttctgttttgcatgtttttagtttttgatatatcatcagtcatccaaatggaggtgtcaagcaaacagttggattcttgagtctcacactcagagtttcaatctagagatatgcctttgggggtcttcagcatatgcatatttaaaacccatactgaatgaagatcacctgggaagccggtgttggaagagaagagaagagagaaaaagaagaagagaaaggaagagagaaaagcagaggggagagagagaacagagcatactgctctgaggcattacatcctttcaaggtccaggaggggaagagatcccagtaaatgaggccagaggcatagccagagaggaaaagagaagcatcacactgatgtgcaagaagaagggaaagtgcactcatttgttgaattgtataattcaggtacatactcgattatgcttactttcacatattccaggtaaattgtattaaaaagtttgaaatccccagatgatctctcaggccttgatttaaaatactctcagagtgacaaccaaggcagagaaattatccactgctagttgtctgacattcactttccaaaggcaattcaaaaataaaataatcaaagtaataaaaatatatttacaccaattatgtatttttgttccatacagttagatattttttaaaatcaacagaaaaaatatcacagttcatgggggggatggtgtgacttttgatacactgtttattttctcctaacaataaaacctcattgcgttattcttgccaggagtttgggtgacacctcgacacattatcatcaattctacaacagtggaattatattggagtctgccagaaaagcccaatggcctcgtttctcaatatcaattgagtcgtaatggaaacttgcttttcctgggtggcagtgaggagcagaatttcactgataaaaacctggagcccaatagcaggtaaactaaaagaaaactttaccaatcatacagcaggatttgtacatttctctgggttgataagaaatgcatgtcccactgaaagttgttaaattgtttaattaacttcctcattcattggccattcaataactgatgaaagtgctaaatcattcagtctttagacttcacgaaatttcttaaaaatataaataattcgtcttctgtttgacataaaagcatgagaatttttaaatatacaaaatacatgaagtattaaactttaaaaattaccaaattatcttcaaaaacacgcatccttgaactagcaataaaagagatgtaaagagttttgttttccgtcaactctcttttcttcttgtacagtgtttctctacttgctacaccacatatagttgtgaatagttttagaggaaaaagttccacatatttgcatttcattcccattcatttctcagcagagacaaaaacatatcttaaatcaacagatgttttactgtagaaagtagagatcaatttcattttattgtaaggaatagcagatcaatttaaaaacatctttctctaaacatatttccctgaactccaacctatttaaaaatggggaagattaatttgaatcctccacaatccaccagcacactccaagactttcctgaaatcttcaagaaaagctatgaattactagcaggttaaaaataaatttaagagcagctgaaattacaatggcttggagacaatgttgcctgtgcaagaaaaactaccaagtcaagtttctggaaagggggcaaagagtttgcaatttgtcacaaatttaggactaagcaattgatacaaaaactagtaatcattgttcaagtctcttgtgcatggccttaccacaattcttctttctttttaaatatagatacacttacaagttagaagtcaaaactggaggtggcagcagtgctagtgatgattacattgttcaaacacctatgtcaacaccagaagaaatctatcctccatataatatcacagtaattgggccttattctatatttgtagcttggataccaccaggtaaaaaaaaaaaagaagtatgtgtgtgtgtgtgtaaacattttaaaggaattaattagagataagaatagaactgttaatttagtaaatcagaaagacatagtcggtctcctggataaatatgaacagaaaaatctaaaccacacttctaagtgtatagacgcatgagtacatacatacatacgtagagatataggtatctagatgtcgatgtagatatgtaagtatatacagctttctatgaaagcaacactttcaagtacaagagactaaaaatctttttactcatctattttttttttttttttgagacggagtttcactcttgttgcccaggctggggtgcaatggcgcaatctcagctcaccacaacctccgactcctgggttcaaacaaatctcctgcctcaggctcctgagtagctgggattacaagcatatgccaccatgcccggctaattttgtattgtttttagtagagacagtgtttctccatgttggtcaggctggtctcgaactccagacctcaggtaattcacccgcctcagcctcccaaagtgctgggattacaggcatgagccaccacgcccggcttactcttctatatatccaatgcaagtcatataggtcagaattaccttgaacattcatttccatgggactccttagattggatcattgacattataccattccttttatattaaatcagtgaatggggagtttggaaagacagttgttcacttcacccatgtaccttgggttgtgaccacttatggtagctgcatttttcctctgtaagctgaatagccttcattgagccatttagtcattattgggttgccttgtgacttagtgcaacattatattttgaggtaagcaccatcctcaggtaaaatcctgactgcattaatactgtggagtaaagagtagagtgagaaaggacatatggaggacttttctttccaagtaaaatttaaaaatggttaagatgttaaaaacacttcaaaattatgtgactttatttttaatatctagtcttaagatgaaattgtgacacgccctttttgtcgccatcagaataagtttagccacagttcaaagtggcaccaaatggttaacagccatttgagccatcggtagatccattccataacataattaacataagcctatttttattgaattgaacagtcaaaacaggtactattgtatagctataaagagagcgtaaagacctaatacataaaacttaagtttcttatagaccaacaccttctgctataatctaagatcaaagagaaaaagttattttcccctaaaattcaaaagaaagtttacaaagagctttataagcaaagaaaaatataagttgctctaagatattaaatgtacatgatttcacccacttttgtttaaaataaatgtgcagcatattaaacaaaatataaaggaataattagtagtggcagaatgcatcacaaagtgctataatctttatgttgtaagagcatagatattcttgaactctgttcttaatttcgatagaggaaaagacatatcttctgctgtgggaaatatataaatttacagccccctttacagaatttatttctacttttgtttaattttatttatttatttatttatttatttgtttgtttgtttgtttgtttattttgagaccgggtctctctctctgtcacccaggctggagtgcagtggtgcaatctcagctcacagcaacctccgcctcccaggttcaagcctcagcctccaaagtagctgggactacaggcacacaccaccatgcctggctaatttttgtatttttagtagaaatggggcttcaccatgctggccaggctcgtctcgaactcctgacttcatgatccgcccaccttggcctcccaaagtgctgggattacgggcatgagccactgcacctggccacgattttttagtatatttctccttggcatttttattgtgctgttgtgtttttgcaccacaaaataaaatgaagctggatagagccaatctaataccatatttagcctattgacaagaaagttttagatttagaccagggtcttctacaatccaaattctccaagagcaatacgggaaatttcagggtgatgagcaaggttgatgatttctttgccatatgactgggaagtcccatggtttatcaaaatatctgttattttaacattatttaacatatcagttgccattgctaatctgaagacttcatgttcagtacgaatttgaaaatatctttattttatgactatgcaagtaagagaaatgaaaaagcctggattcatatcccaatactgccacctattagctgaacttaaacggtctctaggcctcaattttctccatctgtgaagtggagataatgatgatacctacatgtaggcaggtagggttgctgtaaagatcaaatgaagtaatttatatgataaatatattatctagttctatataatattctatagataccaatggtgattgtttgaagaattatttttttatctttaattgctcatttttaaaacgtatttgttccaacatttgctgggtctcaaagccccaattttcaaaataataaaaccacctactgaggattggattagtaaattttcaagacctctttcaaatttcccagcgtgtcatttttttctttgaattcaatatcacacttaaatgtttaatgtatcatgtttccatttagaaatgtatcattgtggaataaaacacaactttcacttgtttaatatgaccttaactctcacatacctcaggctttgtataaattgttcattctggtccagcctaggggatattgtagaatgctttacacactaactctgaccatttaaccaatggttaataaatctataatattcagacctgtcaatcttatagtttaagatgcacagaatccatttcagaaaccatataatataaggaaagattaaaatcttcaattaaatctttttcctggtgtctagaaggatttcaaactcagtaaacagtcagatgattttgacttgtgtataatctacagttgattttattggaaagtacctcatgctgtgttttgatttggataataaaaacatgtttctattcctgaatagtcacaaatatatatattttaaacagaaagaaaataaatttgtaagtggagattgtttatttgctcacaatataaagagttttctaggtattcatcatactccctgccattacaaaatgactacatcacagacagagctgaataatgggcaaaacagtccatgcctgcagttcccaaacctgaatgagcattagaatcacctaggaagcttgtgtaaagacagattctcaaccccaaatttactgaataagaatctcctgggatggagtcaagaaatctagagctttttaaaaactccacatatgactttgatgtgctaccaagtgtttttgaaatagtagcccagaggaccaaggaacagatctaggtattgctgaaaccaaatgattctgggagaacaatgtttgactgggtgtgtagtggcgtgccaagactagaagagttaattgtggaaaatggcaagccgctgaagggaaaacagccacgtgacagcaatgatctctgcagcatgaagaaactagtaactagaaagctttacctacccatccaaaaatctaaaaggaatagatgtgatttaccaaaaacatggatcacactcaccaagtgagactggtgaattacaataactgttttctctgaaaacatgagtccgccagtttctcttgaatgtctaaagcaagcttatccaacctaaagcccaggatggctttgaatgccacccaacataaattcaaaaactttcttgggatctttgcaattatttgttttagctcatcagctattgttagtgttagtgtgttttatatgtggcccaagacaattaatcttctttcattgtggcccagggaagccaaaagattggacactcatggtctaaagccaaaatactggctaaattgtatttgtttttttaaatatgcatttttttttttgtggtcagtgtgaacagagtaaccttagacaggtaagctgctgggaaaaaaaatgtctatgtggttacttggcaactgaaaaattacctaagcaattaactgaattttcagttttcaaactattgttctaatgctataaataaactaagccttagtacatgtttataagtcctactagtgaaagggtaaggtctagggaatagtgacaatacccaggggaagagtacccgtgatactgataacaaatgtcgtgtacatacgttcatattacttggtgtatttgccatttgttaaattcctactatatgccaaacactgataagctccttctctgccttacctcagttaatttttatgcaaacgctagaagacaggtaataatatcattatccccatcttaagataagaaattcgaatctcaaaaaagtaatataatatgctcaaggtcacactgcagagccaggattcaaattcaggtctactgtctgctactgccttttaagaccagttcctttctgtctttggcttaacccttaaatccaaatcgacttttcatttcttgaccaaagtctctcagatttatgatggatcaactatgatgtttgaaatagtagcccagagggccaagaaacagagctgggtgttggtgaaaaccaaatgattctgggagaatatttttttttaattttttttcttttattatactttaagttttagggtacatgtgcacaacgtgcaggtttgttacatatgtatacatgtgccatgttggtgtgctgcacccattaactcgtcatttaacattaggtatatctcctaatgctatccctcccctctcccccaaccccacaacaggccccggtatgtgatgttccccttcctgtgtccatgtgttctcattgttcaattcccacctatgagtgagaacatgtggtgtttggttttttgtccttgtgatagtttgccgagaatgatggtttccaccttcatctgtgtccccacaaaggacatgaactcatcattttttatggctgcatagtattccatggtgtatatgtgccacattttcttaatcctgtctatcattgttggacatttgggttggttccaagtctttgctattgtgaatagtgccgcaataaacatacatgtgcgtgtgtctttatagcagcatgatttataatcctttgggtatatacccagtaatgggatggctgggtcaaatggtatttctagttcaagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgacttgcatttctctgatggccagtgatggtgagcattttttcatgtgtcttttggctgcataaatgtcttcttttgagaagtgtctgttcatatccttctcccactttttgatggggctgtttgtttttttcttgtaaatttgtttgagttcattgtagattctagatattagccctttgtcagatgagtagaatgcaaaaattttcttccattctgtaggttgcctgttcactctgatggtagtttcttttgcagtgcagaagctctttagtttaattagatcccatttgtcaattttacctaggcaataccattcaggacataggtatgggcaaggacttcatgtctaaaacaccaaaagcaatgggagaataatattttactgggggcatcaaaaccagaagaattatttgtggaagtggtgagcccctgaagggaaaatatccacattgcaacaatgactttttgcagcgtgaaggaagtagtaaccagaaagctttacctacacattctagaaggaatagacgtgacttaaaaccagattccaggtgtaggaagattttagttaggtgggaggggaggagagtcacttctcaaattgctgtaaagagatcatccaaattctattttaaagccttggtaaatattcccctgtctcccatgtaaaccttcatccactttaccttattctttcttgataaatgtcagtagtaacattaccaaaacactctaagctctagaaaatcaagatctctagccttttgtgtatcatttgaacctctaaatcaggtgacatacaaacaacatatccttataaaaattttgctgaattaatggaggaacacaatggtgagcgagcctccacaatttattatgcagtcaaatgtaaattgtggatatcctgccatttaaaattactcaaacatttgattttctcttaaagtcatccttcgtctacattaacttaatcttaaacagagacatacacacaaagagagagagaggcagagagacagagagagagagacatttcttctttaatgacaaacagagcacatacacatattttccaaagactgcatcttgtcttatggatgtgcaattttttcacctttcagaaaaggtggtattgttttctaacatggaatgggcttcactatttagttgtcctctggccttgggcaagctgcacaatgtttctcaaattcaggtttctcatctgtacaaggagaaattaaatgcctaccttatattgttatatgaagtaaatgagatggcatggtaaaactccattattgtttgaacctttaggtaatgtaaacaaccttagattattcctaagcattccctctcaccttttaccagctctcaacattgggtcaggacttttgtattcatattaaagagaacatttatattaaagagagcaaaggatatatgttaccttaataggtgaaaaattatggaaaattaaatagcaaatgcttcatggaacataagtggtttactcagaatgacaatggagatagatatccctgctgtttaagaatctaaacattcaaaattatttaaactctgaaggtaataatgagtctttctaatttatcgagatgatgactatattttgaactgttctagcccttaatcatgttctaattaacaatgccattgcatttaacacatactttttctcactaaggatggtgagtcatttaggtttaacgtacaatatagaaatactggtgcttttcctttaacattaatatcttactccattaaagaaggaattagcaagaattctactgataaataatttttattaatattgctctagaaatacaaatttttttatttatcattttgattaaaggttagctggccataatatggtctatttatggacattagacatcttggcattcagttaactcatcagctgcagtgtattatttcagatactatgcatttaaagtcaaaatttacattaatctttctaaaggattcacattacattaattgggatgattcaacattgacagttgtttcacttttcttaacttataaatgcaataaccaaatgacaaggagtggtgagtttcagaagaaaatgtgaaactcacttcagtggtttgtattttattttggatattttaaaatgtatctttcattactgagctttaatatatgctaggcattttgctaagagattaacatatatctcatttagtgttcataataacttaatatagtatgtcctattgttttgctcattttactaatgaaaaaggtcaatttagacactccaagctattttctctaggttattcttcaagcaggtgtcagagcagggctgaccctcatgggtgtgagtccaagtctgactcaaaactactattctatattttctcaatatttttccacctaaacgtgcggaaagcaaatgatttttcatgagttctactgtaatcccatttaaaagctaaaaaactgatttttgctttatatataggaagtatgaatgaggacaatgtaattcaggatcagtcgacccagtaacccaatagaataattttatttgtggctcaaaacttcatgagatgtaattcatttgcctttgggtatattgattcctctagtcatttaactaacgtggaaattatttctgagccccactcaggggcaaaacatgatgctggacaccctaaaagttacaaagaggaatgagacactgtccctcttgtcaggaaccctaccatctagtaaggtagaaaagacataaatgataactattatacaaccaatgttaaatttccatacaattggtatgaatgagttcaagagggtcccgttttacttctgttcccccaaaaaggcctaatcaaggtttccctacctatacagtggagaatttagctcgatttgttaaaagcaccatgttaagtgcaaccaagtgttttgaaacaaatgcctctatcaaaccgaattaatagtttttcctcttagaatttttcctgttccagctcctaaaaaaagacttaaaaaggattattgattgacttgtcccattgtaaagtatgcacctgctgtgaaatgaagccatggagaaaaatagttgaataatttaacttttttatttgtaaagataatcagggtttttctgattacatcttaacttcataaatgttaaataacctatcagcatctagttgttgtaaattatgaaaaggagcattgcaaggaatattaaccaacgaaatccttgttctttagtgaacaagaaaatgtgttatggcagcttgtcattgtgcgactggtaactttgacaccaaataacaaaactgccatttgcacttagggtaaattggttcacttgagcttccactgctcctcttgctctgacataaatttatgaactcaggaactaaccaagtcgtgtggcttcccagctgactttaacaaatatgcccatttcatttcatttagtcatcagaataccagggggctcagtcatttcagactcattgcagatggtatagggtttgtaggaacaccagagactttcgtgtcacagtcctggaaattatgatagtggagggggcccactttcctaaatgcatgccagtgttttacgtgttcacagcttagaggagcattttctgtttcagcacctcataggtatatgtaaaggacatttatttccaattaatgaagaggtgaaaaatacattttctatgctcatggtttggctagccatgtttaaatctggattaagattatgtttatatttgacatgcggtagaagcacagttttgttccttcatcctctgggagtcctgtcctttttataacagaagttacttcttgaaggatgcaaggcctggaagcagaacagtaggtacagactgaagacataaagtaaaacaacctcagatgaattggagggaacgccactccaaattactgctaacaatgaataatacagtattttcgtaggaatgcaatttgatcatatccaagtacacataaaaaataaaactagataacaaaatagtgttacaaagacattaacttgaatgaatgtaacatttatttgtagttggaatagcaactttatatgaaagatggattcaaaagtgtttgagggcacatggaaacagtgccatagttgttttttgttctttatttcattttgttccattttgtcttgtagagatgtcagccatttattaagtactttctatgttatgggaatatattgaaaggcttacagatattttctaatttaatcctcacaactctctatgaggtagctattagtatcatcattttacacatgaagagacaacatccatagaggttagttaatttgccagtggtcgcttgggaaataagggcagcagaaggatttgatctatctgacaccactctgtggtttgtctagttcaacaagaatgatggcatgtttcttatgaatgtgtgtctgtcaaacttttctgcaagaactgtcctaggaacaaagaagacaggatgaatatgcaatcccaggaggtctgaaaacagagcctgaagcaatcatcattagcttgcagtttctttaaggtcttgctttttatcttaaaaattcatgtaaatttgccattgtattccagtgtttgtcttcatccaaaaaataatatattatacaacttatcatttgggaaaacattttctactaatctcattggctaaagagtgataatgctgttatatttcatgatattaggaagatctaaagaaaactaagcccaataacaggttcaaggtcccggcaattcttcccctcttcattttgtcataaatatgtgggttcaccgtgaggcagaggttgcagtgaaccaagatcatgccactgcactccagcctggtggcaaagcaagacttcgtctcaaaaacaaaacaaaacttgggaggccgaggcgggtggatcatgaggtcaggagatccagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagactccgtctcaaaaaaaaaaaccaaacaaacaaacaaacaaaaaaaaacaaaaaacctgtggcttcaaacaacagccttttattcctcactgctttactgttatggcagggtaacaatagggagaaatgcccaaaatgtgatatggaatgctttgtcattctaggatactctggatggaaatttctatcagcatatcctcctgctgaaggtcaaattgcaaactgagagggtccccgattccttcttcaatctctcttaccacctcaagcaacaccctccaaaaaatactttttgcggagaggaagaagaaacctgattatattactttttattttacctctggcacagtacttaaatttttctcatccattaatgaactgagtctcaaatggtctctataatcaattctccttatccagctctcaaatttcattttaattattgcagtcttgttgagagcagtaaaaactgccagttttgtcgtggagtggtgaattaggcctcgaagaatagcctttaaataggcctattatgtgtattcaccataccagtaaagagaaaaataaagttattttttaggcatttaatttttgttatgatatcttttcctgtttctttatggagaaaaatagtatagaactctttattacctgaaacaaagtggaagtgtcatgggtcaggccaacttttcatcccatgtctagggtagaaaatccacattgagttcactttaaagcaatagcgagagactaacattacattgtcctttggttacagtatgaacagttatacttgttcagcacactggcacatcagcataaacattttcttgtgtcctacagttggttcattctgtggtgactacagagtcttcaactctacaattggctagcaaaaattctaatcactcaccatacatacaattctctaatcttgaacttttagaaagaaaaattcacacccaatttttgtgaacaaagaaacggggattctgctggttccccttcctcaaacagggaaatcctgtgtttcccaaattttccatatcaaagtgatactccaaaaaaaggcacagtaagtccttaaggtcatgataggttcttggaaactgcaattttgagtcaaaagatatataaggaaaccaattttaccttaggctagttgatataagcaagatttaagttgcaaggaatatttgtggtcacaaaaacgtcaccaaactaaatatcatcaaagaaagaccaaaacacttctaatattaaactgaaataaatatgagctatacatacatttaagaaagattaatagaaacaagtaagatcatttttaacctaagttttggcaagtcagcgagtgacaacagccatagggataaatgtttttgagcagaaattagaagaaattcttcttaccaccatgcactagtaaaaacaatcgcaagtagggcaagctcacagaaggcttttgtacagcattatttattattatgcatctatatgatagtaacacacttaatgaatctttactttacaattattcattcattcattcattttctgacacaccttttccagttcagggttggggtggccagggcctaaccaggcagctcaagaccattccgttacagggcacacacacacacccacactcgctcagactaggaccattcagacacaccaattaatttaatggaaacatctttaggatatgggaaaaatccagagtacccataaagaaaccacgcagacatggggagaatgtgtaaatttcacatagacagtggctccagctgggaatcaatttttttcctcataaatattaatgaaacaatgttgaatgaaacaacattattcgaggacctacggtactatgtttgttcctgtctttgaatatactttgacatgagcccacaaacctccaaagcaggtgtatttcaggttgggatacttggtctgcagaactttaaatttctacctataatatgcttgttccatcagtaatgatttttacttatccatcatttgtttccttgcttcggaatagtctccaagaatggctctgccttactgcacaaattttctcaaacctatcttgtcatttttccccaagttgtcctactctaagactccattatcaaggaaaagcataagtatattgatataagtgttgatatcagatgggcctaagttcaagtccttgcttctccaattaatcagtgtgcaatctggaacaagttatttaacttctctgagttttagttttctcatcttaaaaaatagtaatatttaccatgcagtattgtcttgagggttcgttcattcattcaatcagctaacatttattgagctgctactttgtgctaaagtctaggcagtggaaccacattggagaaaacaaagtcctaatttatacggttgacattctagtagtattaaatgggataatgcgtgttgcctggcataacacagggatgcattgaaatgactcttgtttgtactacttctgcaaacattgtaagactttcaaactggtttccctatgtcttgtctctcatgtttttaagccactattcatttcccaacagtgttatcattctaaaatataggtagactcttattttcttatttatacctgcaaagtctccttgttgctgattatatatgaagcccaaatttctcaaagaattaattgataaaatttagtagtcacttgagttttggagtgaagaaggcaggatccactctaaaagtcttactctaagatttccatcctaggaaaatgggaagatggtattatgacttactgaaagaggaaacctaggaaaaagaacaggtttgggagtggaaaatacagctagttctgttttagaattgttgagatcgtggcctctgaggaatatccatgtagaaatacctagcaggctgttgaaaatacaaagctgtaataccggaaagatagaaagctagagataagagtttaggaatcaatgatagaatgttagtagtttaacctactagaataaatgtaccagatagtttagccatgatgctctaaatttaaaataaacattctcagtctaagctgccaaatttaacgcaatctagcacctttcctgaggaagcaattgatcagtacttctgaagatgatcaatatctccttcagacacctctttttcatctatcctacacaaaatcctgagcatctttggtttgtaccagctcttccactctgtaaatacagaggccacatctataaaaagcaaaaccacatttcattctttagacctcatctctcttaggtcattgagtcctgtgcttcctcagtaatgttatctctagattccactgtttctaaagtaaagatagacttatgtgggtactacagaagtaaataactaaactcataaatgttaaaaactctcagatcaaggagacaatgtaatagaaaatgccattatattcttcattcaaaactcatatcctctccttgaaaaagtatgcctgttgttcatgaccaaataaaacttaacaagcatttaattatataaatagactttgacgaggctaaactgacaagacctactttctttaggaaggaatggtgaaaaatgacaattgttgaacccaaattttcgctgtatttagggccataagtctcactgacagtgaactgtcctggcccaataattaatgcactgggaattctctaggtagaccatgatttggatatttcatgggctatgtcaaggatccatgtcagacaggaggcatacacaatgctctacagaaaaattattgtcacaagcaaaattggtgttgttttctatgaactttaaaagtaagtaaacctagaaaaaatataggacagcataattgccttatatgttttaagtgaaatgtgccttcatttttatttgccaatagagtatatctttaaatagaaatattatgcttttaaaaatagattatgtacatttcttacttttggaatacacaatctaatatttgccaacttaacttttgtgaagcttttaattgctatattaaaaagtaatttacttttctattacaactttttttttttttttggaggcggagtctcactctgtcgcccaggctggagtgcagtggcgtgatctcagctcactgcaacctctgcctcccgggttcaagcgattctcctgcctcagcctcccgagtagctgggattacaggcacacaccactatgcccggctaatttctgtatttttacagggtttcaccatgttggccaggatggtctccatctcctgaccttgtgatcagcccacctcaacctcccaaagtgctgggattacaggcatgagccaccacgcccggcctcaattacaaaattttaaatagacattatttttaaaagacaaacatttgttgcccattctgttttatttatatatatatgtgtgtctatatatatttatttatatatatatgtgtgtctatatatatatacacacacacacacacacacacacacacacatatatatatatatatgtttttaatgttctctctctctctctctctttaaagggatcctcatccccgaaattcctgtggagtacaatgtcttactcaatgatggaagtgtaacacctctggccttctccgttggtcatcatcaatccacccttctggaaaatttgactccattcacacagtatgagataaggatacaagcatgtcaaaatggtgaaagtctttcagacacttggcctgggcttttatgaaaaagtatttcattaaaaaatttcattaaaaaggaatacattctcagtccaaatataaagactaacgtttcacttcttatttgtagtggactgtttacccagaaaaatcacagtctggcatcgagtaaagcattatgcatttctgcacattaaatcataaatatttaaatatattaaaatggtggttttgcaaagtcttgttttataaggccctttgaaagaaaaacacctagctcacataaaggagtctttggtaatataaaacaaaaatgagtattccaaatatttcatagaaaacatatttaccttggccttatttaaattttatccaggaggaggaagtgagaagttatttaagagttgaattacacccaaatgaatcctatatattttatagtgcttccttgaaccctattcatatatacaaactatcaccttgtgtttcatggcttaggctgtggtcagtgaaattttcatgtatctgtgttgtgttaaggaaaagcctcccccatttcctttatcactccaaacggataagtagctaaatgtaaactgtgatttaggaggggagaacagggaatcaagagagctatacatcattttatttatctcttttaaattaagtataaactttaacagatatggatatgttatatatgtgtatatcatatataacatgatatatgtgtatatcatatataacatatgatatatatgatctcatcatatatgttatataacgtataatactcatttgctaaataaagaaaacatgtaacttaccttagtataaaaaacattttgcttcaccttaaagaaatttatcagactcaatgtgtagtggaaactcctgtattgaatgtccttaggaatttctgtttccaaatagtgctagttctcatggagttggttagaattatgagtctgcaattttgctctgctgaactcatcagaaatggctagtcagtttgtccttttttctctaaaaaatagaccatggcatttttgtttgaggggtattgctttctctgatctgtcttcacctgataaacgtgaaaataattttaaattaatgttttcttgactcaagtacaaagtcaacgtctgcatctccgtgtccctgaaactgtgcaatggaggtacaatatccttcaaatagattgttttattcctgtgtgtttgaataatgttcatgagtttaaaatattggcaaaataaaatattattaaaagcatgcaagatgtgtaggtcacacatacacttgtgaaattcaagtgcattatcactttctggttagaatgactataataaactagagaaacttgagttcagacaagtttccttattattccttatttccagacaatatgccttattgtttatgtctatataaatatgtgactaattaatgggttttccaaaaataattttctatttaaatgttcaaatcccataaaaatttatttaaaacacatgtacaagtatatatgcaaaaggacaggttaaaataattttcatgatatcattacccttctgtatgaatatgtagttcttttccttgcttgaaaaataataaagacctcaattttttttttttcaaggaagttgtggagttagcagtaggatgtttgtcaaaacacctgaagcagccccaatggatcttaattctcctgttcttaaggcactggggtcagcttgcatagagattaagtggatgccacctgaaaaaccaaatggaatcatcatcaactactttatttacaggtaagattggctgttactattatttttagttatttaagaatgcgtactgctccaacacagcagaatcaagagcattttatatttccataagagaatgaatgggaattcatgttgtgtttttttttgttttgttttgtatgtttgtttgtttgtttgtagcacctaccagtgaggactaagactggtgctcaaacttttacaaattaaccaaggaaaaaagccataactgccatataacatttttgattgagatctgtttgaaaactgagaccttatagcccacataggcttatatttagtgatggggcagaacagtcctctaaagcaggggttcctaacccccaggccacagagtccgcggcctgttaggaaccgggccacacagcaggtgagtggctggtgagcaagcattaccaccggagcttcacctcctgtcagattagtggtggcattagatactcacaggagtccaaaccctattgtgaactgcgcatgtgggggatctaggttgtgccttccttatcagaatctaatgcctgatgatctgaggtggaataatttcatcttgaaaccgtacaccctaactgcattgccccagtgtgtagaaaaattgtcttccacaaaaccagtccctggtgccaaaaagtttggggaccactgcttaagcagctcactgaccaagaaaacatagtctttccagagaggaaaccagatacaagacaagaattctaatatttctcattaattattatgtagagattaaaaagttttttctcctcctccaaagatggtgcttttcataagcagaaaaaggggctctcctctccagttttccttctgttttaatgagcctccactccactggttagatggtgttatagcaacttgttccatcatgtgcagaatttattaagtgtacctacctaaaataaagaaaagagacaatagggaagagaggaagagaaagattgaggaaaaagagagacaaagagagattgagagagagagagagaaaataatggaagagagagatacactatgaacattttggtttgaaggatattttgctctctgatctagtcttcaccagatcaacatgaacattgctttaaattaatgtattctttaaataaataatgaatgaggaggagaaggagcaggcaaaggaagagaatgagggagagatggagggagggagagaagaagagaaaaaatagagaaagtgaggggaggtgagtagaaagtacaatgcaaagagccaagggggcaaataacctgtcaactgatggcttgctacttaagacagaaaatacaatcattggtagacatacaggacttgcagattgaaaaacccaatcccattctgaaagcaatgtatttcctttagcgtacaaagcagaacacccttcttctcagatcctcataccccgcacctcttcaacatcctttgttagtgtctctagcagcctcaggccttcccttatttggtcctatgccctggaaacttagtgaaacttacttaggctcctcttataactttagatattgaaatcctttgattcacatcagtcttcagtgatgagctaagggcttatagaaaaaaattacgaaaggagaaagtattattgcatttctggttatgtaaatgacattaccaaaaatgaacaagccaaatttcttctcagcaaacattaatttgaagaataatatttctgattcaaaaacacatgaacacgtaaaaatggttaatgtgaatttccattttacgctaagcacattagtgcaggctctaaaatgtccaccctcttgaaatagttttctttcatccacttaatgctaattgcatgagaaaagcacatcaaattcctattcagaataaagggaaatagagtatctgttatagaccaggacgtggcttcactctgttggttttgtaaataaagctcgtgattacagtgcctattccatggcagctatagagagggaaaacaggaaatataatgcagaaagcccgcttcaatgaaaaatactgtaaattgaatttgacagcatttgatggcatctgattattctaatcacagccaaacaatgatataaagagtaatatgaaacagaatgtgttactgcctagcagactcaaaagcaataaaccttcctccaatgtgacacaatcacttcacaatcataattgtagcctgtttgatacctctgagtacagcagaagggcactgactgacatagatacattttgttttttatttaaagtgaaatgaaaatggcgcactggggctccagatacaatcgttatattcacctacataggcatgaatcacttggcagttatttcaactgaagtttaaatgtgcttagacaacaacaatatcaaatttttcttagatagctgcaaaaaataatcagaaatttgtaaggacagaaatagaatggagacacatagttctttttcattctgagactacatagagccctttatatagttatagccaccagcctgcagtatttctgaggaggttatggcatgtaatttcagcttcatcattggccttctctttcttctatcggcaccaaaggaagtacatttagctcaaaccaaagataggatttggcctatgcagatatttttattaacttgcaggaagcccacttgtaaatctcatttgaaattgtttgccactctcttctcaccaagaccctgaatcattttcttttctgtaactgtcctttattttttaaatatttcctctagatattatcctattaaaaaatatctgacctaataaagacagaagatgtttatgacttcaaaaacaaagcaaaataacctaaatattatcctattaaaaagcgtctgccctattaaagatagaagaatgtttataatttcaaaaacgaaacaaaataacctagtaagaacaaactattaatatgattccctctgcttagtttatctgtttaagctattttgttgactatatataagtcacaaaaaaagatttgctacaaaaagttttgtaaagaatagagaccaacatttaagttagtgttttgcaacctgtttattgactgagtatagacaagactgtcttggacatctgcttcctcctctcaatgagtttggctggtatgataatgattcttcagtattccccctttattttatatctgcaaccttgcaaatggcaaaaatctcatcacttacgtctacaaaatccatcaaacacattaaattgagactttacaaaacatgtaataaaataatctcctcccactaggtgctttaattttaatagaaaccaaatttcatggggtttattattctcatgagctttctctttaaataaataaaaagatttgatcaatgtgcactgagaggcaaaactatatacaaacaccctgtaaatgctgtaaaaatagaaacaaatgatggcacttccttctgagtatttagtaagatttaaaggataaaatctgaaataattttgaagactgtatgatatgaaagggttttcaaagcagataagtgaaaacattttataaaatggataattaagctgattgaattaactaagaaaagacgagcattgaatcaaaggcaaaggaattttgatgtaattcaatttgtattgggtggaaagatggatatagatatgaatatttatatagatagatacagacagaagacagacagacagacatctacctatccatacatgtacatatctactgagagagacacaaagatctatgagacctaagcccttttaccaatgatcttcactacagtgggagatataagacaggctaaataaacaaagaaaagagtaaaatatatagtggaaaaacagaaatatttaccagaaaatttagagaataattctgtgtctagaatattcatggaacacttcatcaagttgatgtcattgagactaggacttataaaataaagatttaatgactatttaaattgtaagagaaatacatttgttagaaaaaatgttttaacagtacagaagattactaaggttattattcattcttatgatttactcatggcatatgtaattttcactaatagaagtaacactattaattttaatatattaacattaatgttttctatttgtattttcttcttcatgaaagaattatattgcccatattgttctgcaattttctttgggcattttatatatatgcccacacacatatacacacctaatttcttttaatgactcatcaatattctgttatatggatgtgtatcatatattatttagccagtaccctgatgatggcaagataggtgattttcaagttttcgttaccacagcaattctctaataaatattcttacggtaagtatacagagaattattcttagtactagaagtactgggtcaattaaaattgttgaggatttgtctttactagaccatatgcatttaaaattgttgaggattcctaagttgtcttccaaatatcatatgtaagaatttctaattctgaaatcttttaatacagggtcagtcttccaaatctgtcagctcaatattttcatttgcacatttttgttgttttaattcaagttttgatgattataagtaagattgttcatttacttaaaatatttatcttctatttgggaggggtatgtataatatattataaattcttagactaattttttctactggattatttcttattgtctatattctttccacattaaagaaaatctccctttcatgatcatattaaaaataacacattaattatttcttccagcacttttatggctctactccttatttctaaatatggaattaatattgttattggaaattagataagaattcattttcttaaaaaatgctaactagtttatcaacattatttcataatccactgatttgaaatgtcactcatacaaaattcctatgtgcatcgggttcattttaggactttgtattctgtttcacttgtggtaaatagggattttaacaagtacagcctgatggtgaagacatgataagtgaataaaatcaatagaataagcaaaatttccaacacataagcataggattcaaggaatggtcaggtttatctggagtcattgctattagtaggggacatttagaagatcagcttaatgatagattttagatctaaggagtttaggctttatattcagaggcaatgtgagctgctgaaggtttagggggtaaatagagaagcaatgtaataaagtggaaagagtgtggcatttgtagtcagaagatatggcttccagggcctggctctaacacttactagttatatgaccttaggcaagtcactgtgttccctaattttccatttttacatgaagtgaagatagtaaatataaaagataattagcctcttggaattctgtaagaattaaataatatgtgtggaattactgttaaatgtgaagcatgataaaaatagaaagttatcctagatatgttgtccaaagccatgttttagaaagacaaatccatctggcagttatagatgtacatttaaagtcaatgaaagaggttcatggttataaaagtagcagcttgcataacagtatgcctggtaggattctgttttcctttaaatatatagtatattttttacatatatatgtatataaaaaaatgtctggaatgttaaacaccaaaatagtgctagcagtgcttatctccaaatattaggctatcagtgattcttttaaatacttctgcttttgttcatctgtgttttcttattaatttttatagtcaatacatcatatggtctagtaaagacaaaataataaatttgtgagcccagatgcaaatctatcatcactgtctccgattttcctatttccttctttgtgtgaatatcaccatcactttctgtaataatcaaagtctgatcaagaaagaggaaccacactacttactttaacagaaggaatttaatataaataattagtaagtagttataaatttgttaactaggtaactaaaagcataaaaagagaactctaagatatcatggaggtggcaactacaggaaacagctagcacctttagaactgagggaacaaaggggagttgttagaattattaaaatgtaaatgcatagaggagggtgcctgtgaagctgggactcagacagttgaagaggggtacctgccactggtgcagttgtatggaggaggaaacatgaaattaagttggttttccaaatgtcggaaaaattgcatgctgcaatcacttgctcccaaggtatttctttattgcaacacaagaacagcctaatacagaaaactggcaccaggagtagcgtgttgctatgaagatacctgaaaatgtggaagtgactttggaaatgggtaacgggcagaggttgaaagagttgggagggctcagaagaagacaggaaggtgagggaaaatttggaacttcttagagactggttaaatggttctcaccaaaatgctgatagaaatatggacagtgaagaccagactaatgaagttggagatgcaaataattgagaactagagtaaaggtcacccttgttatgccctagcaaagaactaggttccattacatccatgccccagggatttgtgaaagtgagaacttaagagtaaaaacctagggtactggtggaagaaatttcaaagcaacaaagcagcattcaagactttgcctggctgtttctaacagcctacaatcagatatgggagcaaaggaatgactcaaagttggaacttttatgtaaaagggaagcagagagcaaaagttcagaaaatttgcagcctggccctgtggtagagagagaattcaagcagactgtggagtgaccactttcaagagagactagcatcactgtaaggtagccaagtgttaatatccaagataatagggaaaaggcctagaaggcatttcagagatcttacaggcagcccctctcaacacaagcccagaggcctaggaggaaagaatggttttgagggccaggcccagagccctgctgccctgtgcaggcttgcgaactgttccccacatcctgactactcttgctgcagctgcagctcgaagggcctcagatacatcacaggtaggtgcttcagggggcgtacaccaaacccttggtagctaccatgtagtgttaagttggcagatgcacagaatgcaagcatgaaggaggcttggcagcttccccctagatttcagagaatgtatgagaaagcctgggtgcccaggcagaaggctgccacaggggtgaagcccttacagagaaactctactagggcagtgcagaaggcaagtgtggtgttggagccaccatacagagtctccatcagggcgctgtctgttggagctgtgggaagggggccacttctctctaggtcccagaaaccatggacagcttgtatcctgaaaaaagccatagggattcaactccaatatatgagagcagccacagggtctgcactctgcaaaaccacagggttgaagctacccaaagccttaggagtcagtgcttgcagcagtgtgccctggagtgggacatggagttaatggagactattttggagctttaaggtttaatgtctgtcctaccaggtctcagacttgtgtgggccctataggccctttctgttagccaatttctcccttttgcaatgagaatgtttacccaatacctatatccacattgtatcttggaagtaaataacttgttttgattttataggcttataggtgaaaggagatgagtctccagatgagattttagacttggtacttgagacttggggcttttgagttaatgctgtaatcagttaaaacttcggggaactattgggaggacatgatttcattttgaaatgtgagaaagagatgagatttgggaggccagtggtggaataatatagtttgtatgtttgtcctctctaaatctcatgctaaaaacagattcccaatgttgcagatggggcctagtgggaggtgattgcataatggggtcagatcccttatgaatggtgtagcaccatgcccttagtgataagtgtgttcttgctcagtttgttcatgatgggagatctggttgtttaaatgtctaggactccacccgccccccgcccccccgccacctctctctcttgctcctgctctctgcacgtgatgcacttgctctttcttcaccttccatcatagttgtaagcttcctgagtctctcataagcagatgccagcatcatgctttctgtacgccctgcaggactgtgagccagttaaatccctattctgtataaattagcttacctcaagtatttttgtagcaatgcaaaaggagcctaatacaaattagaaaaaagaggtagcacatagaaggatatgataactcttatttgagagaaaagcaaggaaaagactttctggaaaaagtgatatggggctagaattttaaaagacgagttgtagttagtctatagaaaaaaggagaggccaggtgtggtggctcacacctgtaatcccagcactttgggaggctgaagagggcagatcacaaggtcaggagatcgagaccatcctggctaacacagtgaaaccccgtctctattaaaaatacaaaaaattagccaggcatggtggcaggcacctgtagtcccagccactcgggaggctgaggcaggagaatggcgtgaacctgggaggcggagcttgcagtgagccgagattgccccactgcactccagcctgggcaacagagcaaaaaaaaaaaaaaaaaaaaaaaaaaaagaaagaaaaaaggagaataagaaagaggattgggagggatattgccagagaattagcagataccaaagccatggaaccgtgaaatataatggaatataagaaactatagtcaagcatttgatgataactagaatataaaatgggactagaaatttcagaaaggtgagtccttttgagaatcagcagattaaggataagcataggccattttacatggtaaatctctaaagaatttttaaaaggactgtcttaaaatttttgaaaggtttgtgatgtctcttccctcaacagccaagtctctactcacaccaaaaacttgacgattcaaccttcacaaatcattttgtaaatcacctgtgtttccatttgtcctctcagcaatctagttcagggtctgcatttattcttacgtaaactgttgagatgacctccttgttcaatgccagatgcacatcatctccatgataacttcattcagatcatgcattacattttacccaatgatttttatgttttaatttttataagaattttcagaggtttgttatactctatgaggttattaactccactttacaaaatgaaatagaaactagaggacacagacaggcaagttcacccaaggtcattgaactaagtggcagagccaggacctccaacctatctcctctgactacagatgtttctgattatctatttaaactcagaatatttgtaatattcttcatggaatggggttggcagtttcataacctcaaaattgttatggtgcattgggttctaggattttgttttaattgcttttgaaaataagcagtgacaattgctggaggggagagaaggagtaaggagctcctaaaagcattgtacattgagaccacagaagtgtgactgcctttaaaaatatatggttcctagtttttatacttatttttgttttcctcttagtgttaggcaacattaaattaactctagttggaaaattacattcctgaagtatctcccaaatgagcctgagcaaagaataaccatttggctattcagagagaactgaaaatgtgatttctctaaacacaggctactcaggaggaaacacttccagttaaatgaacaggtgatgcttaaatcttaaataattaggaataattgtggtctactcaaccacttctgctctaaatgtattcagacataaagagagactctgttttttagcagtgcagatgggacatgtacttctccacgatattaatttttcaaggattcaatagcgataagaaatacttaaccaggctgcaccttttaattcttttggtgaataaacttgaggccaacataatactcaatcttttaaatagtatatgtatttaaaaccccacttttaggcaaattttgttaagaatgtcggctttatagaaaccatgactacatctcaatttgggaattcgtgagagtttaataaaaattaattgaattgtcatggaaaggctgaagctagacaaaatagaaaatgttacttccccatagaccatcataggtttgtttgctgtattgtgttcctagcaaacaactttttaaaaatcactgagaagagtccttggctatgagccctgcagttctcattagaatggatctctcccaatgacacacctggtacctgatatctgtagcaagtacaaaggccaaaccctgcaaaccttcactgagtgcagaatctggttcacgcatggtagtgagcaataatgaggtgggctgccgaaccataattgcaggtgactgagaggtgtctatgaagcctctatagcttccagcatgaagcttgtcattgctcatacttaggtcatcgtgatttatcaacttaaggatcatcagattcccaaagccaaagattttacatattctgcctttttgtgaaaggtaactgtcattcactttgtcttaataaccctttacattttgatggagctggttaatctgatatggcagcatgtgaatttttcagcatctgaagagtgtgttaattaaatacttctaacagcctggaaaatattactgtattcatcactctcttctcaactagagagagagctgaaagaggagggtcaatgtcttggttacattctctcccaacctggaatactgccctgataggaaataagagctgatggagaagaggcaaagatgcagggaagtaatgggattccataacttttagcctttcacttgaaaaacatgattgaacacttactgggctcagatgctgggaatatagagatatgccaaccacagttcctccagaactttgctttccatcaaacctgcatcatgtttttacatctggatgagaaaagaactgttccaaatgaagtatcagatatatagggccgtctcaacaactcaccattccatttctcttacttctatatttaatgctatatatatttagtaccaaaagagtatgcatttggccctagtttccctatcaacaaaatctaaagatgagcctaaacaattccatcctcagacagttgaaagaattttggggtcatactctgcattttaccaggttttggggaagacatctaaaaggaatttgacttttgtcctttaaaaatctctaaagcaagccagacatggtggctcatgcctgtaatcccagcactttggaaggccaaggccagaggcttgcttggggaagaccagcctgggcaacatggcaagacctcatctctacaaaaaaattttaaaagttagccaggcctagtagcacacatctgtagtcctagctactcaggagactgaggcaggaggatttcttgagtccaggagtttgaggctgcagttagccatgattgcatcaatgcactccagcctgagtgacagagtgagacccagtctcaaaataaataaataaaacaaaaaaactctaaaacaaattcctattatattacttatcatgttattttcattaatctgcacatagctccatcttctctactcagctacctattcctttaggtaaggggtgtgttcatctttttacccttgtttctaatacaatgatgggcatataacagtgcttaataaagttgttgatgtataagtacaataaatgtagaaaaaacagtggtcttgatgtataagaaaagattgtccatactttgagaggttatggtttaaattatagaagagaaaattcaaatgaagagaaattaagtggcatctaagaagtgaatttaaaatactttgtaaacatcctgggaacaattgcaaaagagcattgtgctgcatgagagaaaataggaactgtggacttcccttcatagttcttcatcatccagtatgccaacctgggctttttcacacagtaattttatggtcctaagagcagcaaaaggatcatcctcaatgtgcaaacacttttgaagtctctgcaatcatcatatttgctactgtcccatgagccaaaaaagtcatatagccaagctcagagtgagtttacgagcatactcgcaaaaggcctggatacaggaagacaaacacattgggaccctagctgcaatccatttatcatagaagggtaaggattcccaataatagcttctactaattccatatcctgtggttccagttgtacaaaaaataaaaccccgatataactgcatgcatacatgcacacacacacagacacatacacacagatctggaaaatatataaaaatgcattaataatgtttaatatatgcttctgtatttttaaaagattttaaatatgtttgttttcttgtattgcatatgtatcttgttattcagcaaaaacatctggaagataataaaatgtgattttggatgaggtttcaccttttgtgctttttatatttcttctgtgttttccatgttttctacaaagcatatgcactcttttataatcagtcaaatacgtgtgtgtgtgtgtgtgtgtgtgtcaactacactttaaaaatgatatggagttaggccactggagtacttctccatctggtttttctttactatgacaccaggaagaaacagctgaaaagttaagttgataacaaattctaaaaaaaatgtttttactccatctacaaactttgttttgaagtgtgcagctgtcactggttgcctgcttggtttcctttcagacgccctgctggcattgaagaggagtctgttttatttgtctggtcagaaggagcccttgaatttatggatgaaggagacaccctgaggcctttcacactctacgaatatcgggtcagagcctgtaactccaagggttcagtggagagtctgtggtcattaacacaaactctggaagctccacctcaagattttccagctccttgggctcaagccacgagtgctcattcagttctgttgaattggacaaagccagaatctcccaatggcattatctcccattaccgtgtggtctaccaggagagacccgacgatcctacatttaacagccctaccgtgcatgctttcacagtgaaggtaagaccctttagaaaagtaacagacatgcagattatctggtgaatacgttgaaattaattttcttgtccaacttctcatttttcttcacttagggcttaaatatatgaaaatctttcacttgtgaaaagttgcaatgtagtcacggggataagatactgaactgagtatgaggagtattggagaccagtttgtagaccacgactaattttgattacctcaaaaccaataaataaattttatttattcataaaattgcctgatttccattttccatatttactaagtgggaatattttttttttgagacaggctctcattctgtcacccaaactggagtggagtggcgtggtctcagctcaccacagcttctgcctcctaggtttaagcaattctcctgcctcagcctcctgagtagctgggattacaggtgcccaccactgcccaactaatttttgtatttttaatagagaggggttttcaccatgttggccaggctagtctcgaactcctgacctcaagtgatctgcctgcctcagcctcccaaagttctgggattacaggcgtaagccactgcgcctggcctaaatggaaataatttagtcttgatttccattttccatgtctactaaatgggaataatgtaatgctttcctccatacctcatagagatgaggttcagatgaaattagacagaatatttaattttctacttccccaacaagctagtataatatatagctatatatatatgtatatgtatatatgtatgtgtatacatgtttgtgtatatatgtatttgtatatatgtgtgtatgtatgtgtgtgtatatatgtatttatgtatatatttaaatatacacacacacacatacacaaagttgcatacactatggcttactggtgatttttttcagggatggcttcctctggcccatagaacgacttaattcagttcacctgagcacttagtagctcctgagtgctttctttatgtccagcataacctcatggtctatggaatatacagaaacaggatggtccttgtcacagggagtgttccgttttataatattgcagagatgagaattgcacataaggggaaaagaatgagaagcagttgagtacagcctataatgtccactacactgagacttagatcccgaactccactatctactagctttaaaccacagtacaagagagagtaacatcatataccaagtgttaggcaagaaatgctctgggagatcaactctcaaactgaagatgcttcatggataagattaaattttgtggtcttgggagtgaaatacaaatatgtgccaagaccttattaaatatggaaaaccctcaataagaacaaataaacagacaaactaaagcatttataaaaaaaccaaaaaactatgtttctatgctttaaatcctggaaggccaatttacatgaaggttatcttatggaggataacatttatcaaaatatttaaattacagtgagcaaatatattttcattaaactccagaagagcccttttaaattaatagtttaaagtacaatgttttcccactgtcctcatgtttaattttctcatatgactaaaaaataagcaatatgtaaatgaaaggataattgttttatcttcatttttatctgtttcagaattagtactatatttttattagatagtaaattatgtactagagtcttttatattatgtcttctagttcctatatgataagcattagaagcagtgttcttaagtgtaaaagatactttttagtggatatgtgatccaggaggaagttcgttacttcccaccatatccttcaaactcatgttctaaactttcacccttaaagtaaaacgtttatgagtatactgaaacacccttgttaatagctttctgaatgaggcaccttaatttaaatatgtttttattgaaggcatcaggattataatgattaaacctctgatcttttaaaatacaactttcaggggtaggagcctaataatcatttagtctcacgaaacagttctattggaattcccttgtggaataaccctgtaagtcatcccttcataaccagcttcattttaaaacacaagatttaaagtatatgatgaatccatgaactctgttctttatttaatcttctaggctctatttttatcacactaaaaagcttctgaaaagaggcaagtgtatggccccaagctttaagcggcacagggctctttgcacatgggccctccctgatgtggctttcattttgacagtccagtactggtgtgcttttctatttttccaaagattttttttcttgcaatgtcgaatagattagccagaataattttaaaaacaatacttctgtgtcctatttttgaatgtgtatgtgtgtattcaaagtggcctcccaaaacctaaatctttggctcttagaatttcaagagaaggcttcattagatacaccaagaaaggtcccacctgatcttttcaagcaaacaaggacatcttccacaaagcaatctaggcaagtgttcagaccttctggccactggaccacgttttcagggcatcagggcaactatgactctttatgatctgacacctttgaaggaagtcatcaggaaaatgaactagtgtttttgtgtttcacttattcccacagtccctgtgtaggagattgtgttcaatatttttgtttaaaagatatctaggccagacgcagtggctcatgcctgtgatcccagcactttgggaagctgaggcgggcagatcacaaggtcaggagttccagaccagcctggccaacatggtgaaaccttgtctgtactaaaaacactatttttagtatttttactatttgagaggctgaggcaggagaattgcttgaacccaggaggccacggttgcagtgagccaagatcatgccaccacactccaacctgggcaacagagcaagactccgtctcaaaaaaaagtaaaggaagttctattacttatccagggttctatactcctcaccgtcacagaagaatgtttcttttatctcagacaaatcctgcctcctataatttaagtctatctccctttgttcagagcagcatgacttctccataatagcacaaaggggcttcagggtccaacaaattattgacaattcaatctgatttggcaaataaccattgagtactatattcaatatgtcaatattgaataccaaacttaactatgttgttgaagtctactgtgagacttggcccttgagcagagcagagactgtgaggaagaatgagtgattcgttctgaggcacaggctattactgttgggcattttgggtttttaagcttcttgcagctgcgtttctgctgcccatgtttagaagaccccatttcatttttatttttgtataaacttaatgggtccaagtgaagttttgttacctggatatattgtgaagcagtgaaatctgggcttttagtgtaaccgtcgcacaaataatgtacatcgtacccatcaggtcatttctcatccctcaccctgctccctccctccctcccacccttccgagtctccagtgtctattattccacaccctatgtccacatgtatatattatgtagtcctacttataagtgagaacgtgcggtatttgactgtctgtgtctgagttacttcatgaggataatggcctctagttccatccatgttgctgcaaaagacatgatttcattcttttttatggctgagtagtattctacagtgtgtgtgtttgtgtgtgtgtgtgtgtgtgtgtgtgtgtttcacattctatatatatccatatatataattacattctatggtgtgtaaaattattcctatttagtaaatatggaaagtggaaatggaaatcaggagatatatagatatagatatagatgatatagatatagatatagatatagatatcacattctgtttatgcaatcatccattgatgaacacttaggttgattcaatatctttgctattgtgaatagtgccgtaatacacatacgaatgcaggtatcttttttaatataatgatttattttcctttgggtagatgcccagtagtgagactgctggattgaacggtaattctacttttagttctttgagaaatctctatattgttgtatattgagaaatctctataggggttgtagaagactccattttaaatcgcatcccaagtacttccctagatctacttactgtttatctaatttctgcaccaggtaaacaactttactgtcttctttcctttctgtgcctgctgtaggaaatttttcaagtttttgtttattggccactctggctaaaattcttcagggcaaaggaactacagaaccttctccattaatgaggcacagagtccatccccacaactgtaggattgcagttcagtccacaaactcgcaagaggtactgctaatgcattagtcccttgtttattaagatctcatctctgcccaaggggccatcaataaattgcccatgttgtggtgccatcactagcttgccccaaggtccccccagagttgtttatagacaggtggatgttgctgagagagccacataaaacaggtgcaatggaggcatgaattctgcttgtggtggcagtggatggagaactggcagtgggggccctccgtgggggtgagaagcgtatgtgttggcaggaacagcagcagcggcagcagcagcagaggcagcaggagcagagaaatggaaagagtgtgggttttaatgcatcactagctgctctcccaacctcatgaaaagtttcacctccctactcatctctatgtaggtctttctaaggaagaaagagggagatcaagattcttggggtctctttagaccaataccttccattattgaaaacagctttaattagaaggccttaaactcccttcccaattagctctgtgatgaattgtgcggtgtcaggaaagaaactgtatttagccttgcttggcatgcaggagttccatggtggtatttacagggaacactcctggcaaggttggcgatattgctaccaccatttgggtttgtttgctttttctcactggcatctgccattgtgctggcagaaataaatctgataatttgggattttaaagaaaaaggtggtttacctattatctgtgccctaactatatccttgcttgttccacggggttataaaacgtcaagcccagatcatgcatttgcccagtatcctaaaagataaatggtacttcactctgtgtagaatcaagcataaggtgctgagaaataagcaaattatatgggtcactaaaaattggcttccaatctgggaataaaatccagaattactaactctagtttctagattctagttgccaggcttcctttcccaatgtcaaggaggaggtagtcaaaatttcctcaagggtttgtttcctatatctttaccattaagtagatatgtggcaaaaataataacaataataataaaatagatatttcacaattgccatgttatgaagagtgtgtgagtaaattgataaatttatttttaatcccattttcattttggcttagataacataaaatattactgctctttacatatgatcttaaattagtttcaactctttttaatttgatgattcttagccttttctccccagacacatttattagacaacagaaatactctgggagatgtagctttctaaaaggactcctttggtgactatctttctaatgtgaagaaaaattcagtaataaaaataattatcatatttcctgggtcggttctataaactgagattttcacattttataataagaaataactgtgtcattcttctatataaaagatagaaaacatgggtgagtaaatatcacacaaaacaatgaatatttgtcggcctaaccctttttttttttttttttaaagagacagggtcttgctctgtcacacaggctgcagtgcagtggcaccatcatagctcactgcagccttgatgtcctgcactgaagtgatcctccctcctcagcctcccaagtagctgggactataggtgcatgccaccatgcccagctaattttttaaattttttgtagagattgtgtctcactaaattgccccagctggtctcaaattcccggcctcaagagatcctcccgctgcggcgtcccaaagtgttggaattacaggcttgagccactgaccatggcaaaactttttagttgtgatgatattttagctttaatatcaacttttcatttacttgccttacataatctttaacccttttgtctaatttgggctagacaaattagactttcagacaaatatgtatttgtctgaaagtcataaatacatataaagaatctaccttttgctcaacattattggggatgaaaaccatgtaagtcttttgaaatttatgtaattacatctttgaaagagccatatttttctccaaccactttatcccagcaagctccatcaggattcccttgctcacccatcagtaacatctaaggcaggtcccatgattttccagtcacttttcagtggcaaggatcaacgcaactggtgattaagactcattccaagtgttttttaaaaacttcagtctagactgggggcgatggctcatgcctgtaatctcagcactttgggaggccgaggtgggtggattacctgaggtcaggcgttcgagaccagcctggccaacgtggtgaaatcctgtctctagtaaaaatacaaaaattagccaagcatggtggctggtgcctgtaattccagccactctggaggctgaggcaggggaatttcttggacccgggaggtggaggctgcagagagccgagattgcaccattgcattccagcctgggtgacagggcaagaacctgtctcaaaaaacaacaacaacaacaacaaaaactccagtctaaattaaaacctgatatgtgcttaaggatctgcagtggggaaagagggcatggtcattttcctctttcttcagttccctcttctcttatttatttccccaggatcatggcatgaaaagaaagaattagacaaaaaggaacagagctttactcaataatattgctctaattaatcttctattaattttgagggggcagatgcctcatgggattttctctgtgggttatataggggtccccataggaaattccatgcctcatagtcctctgatgcaggcaatacactctctggctaatttcttactatttgttattgtccaagaggtccaccctacaacctttttttgcctctgggggcccttctcccaagcaggcagccaatatcaagtcctatcacgttgacaaaactcattcctttcttggcacccactaggattgcagaaaactttggtttcaccaaataatgaaggtacagcttgtccagtactatattctctgcttgacctatcatgctggatgaaacctagccagtctcctaactttggaattcattgactaagacacaggtattagcttctgtgctagcctattatcccaaaactatgggatcacttaaggatttcagaagacccttttgactctagtcattgcatcaaaattgtcctatgaatttcatcagtgcagtaggaagcctcttgccaagaccagactgttcatctcacttttctggcaacactcccaatttcttcaagagcttctcttggatattccttgcatgccttgaaaggggagtgtggagaaatcccattccctccctgaagtgggaaagatataaccaaagcctctttcttctccactgaatccccttctttaattttttttatgaacttggatcttctcatataggttgtctacatagatcttcataggaagatggatcttgaagtctgttttttccataagtcatgcagtgatatgtctagctgttccagtagagttacttaccacctatttttctaaatcatactcattattctccaatacagttctgtttcacatcctattatataactaaatggccctatcatctttctagttgcacaagccagatcatttttgagtcctctctcttccttacttccatatcaattcttcactaagtgctattgattctatttccaaaccatatcttaaatccttccacttgaagacaacattaggatcttcacacatgttaatccctcctcctggaatgatggctcattctcctataattcatctgtcctcattcttactcatcaagtctgaactaaaatgttgcttatctcatagggctgctgcaatgactaataaattaatgtatatgcaaagtactgtaaagggcaatataaatagactataaacctttagcagtccttctttttgaaaaaacagagactggaataaattagcaaatgtagataaggttctggtttgtctaggcaactgtactaatttggtcatgagtgaaaaaccttatgttttatacattttaagtgttcctcaccttgcaataaaattctgagcttgcaaatttacatgtttcctgataccacattgttaatttccctgtaattttccaaatactggattaggttctatttcctttctaaactgcctgaagcaagaacatgctttttttttttttttttttttgtctcctgaggtttattacggtcttatccctggcccccctgccccaacaacatcacatacctgccagtctaagagccctcctcaggagatttccaccctatatgtagttctctttacctgacatgacactcttaggaccctaccctttcccttagatctgggattatatcagcagaacatgatgaggtattttagtcacacacacacacagacacacactctcacacttctcaaatcatacaaatggattctgccaaattggcatctacctacttcccctatgccaaatagtagtttatcagtacatgagggacagttagttggtggggagactgtttgacctgtgagtcaagtatgttgctattttctggcctttaaccaacttacaaggaaaccctctttagacacctaagactcccgtggagccttgtcaaaaatgtctgtgaaagtaaaatgaactagtccacatactaacaggcccaggccataaattcagaatatatgccatttagcagagacagcaagctgtaaatggcagtgaagggcagaagttaattgaactactctgctcttgtcacagatggaaagtagccactacctgagacaagatggctgccccgaagtaccctattacagccaagagatcatatccttagctctgcaagggcttatgggtgagggggaaatcatacacagatgaccaatttttttatggttcacagccgataaaagtgaaattcagcagctgttcaggacaagtgaccactgtaacagctgtaatataacctactaaatagagagggaattgcattagagcaagaggttagctgtgatcatcggcaggtgagtgctttattgaagttgaaagaccattaacattgatagagtaattatttcaacttgaaagtaattaccttgatgggtgataacttctctagtgttcccagatttgattgggccaaacaattgtgagctcctgaagcctagaaaaatattacaacaatactgtgatttttaaattactgaaaccactgttggaatattctaattatgccgaacagtgaaaagattttgccttacacaagctagtgacctctcatgtagagagagacatttgctttttaatccaaatgcaatgacccacacccaccacctgtgaatacatatgtgatgggtttgcaaatgaatctttttatctcaatataatttttaaggtgaaacatcttgttagtgctgtgcctgggtaatagtaagctagaactgctgacatttttgatcatatctatggacttgaagtctccagaatggcaactatcttctatctttgtcacagagggtttaaatttgtataaattaaatattttgataatgactacacataaattagaatttctggatgccacgtactttggatcccaaatttcagatattatctagttacataatcagttgtttaaataactttctcgcctgatgttatgcaactccactacaaacactccattgtcagggtattttccgtttacctacactggacatcagcaaacaaaattaaagttgaaaacctgggctattgcttctctgtagtctcatgaatatatgaaaattgcaagttatttgcaattgagggccaagacacatcaaatctaattcagtgatcaagaccaagaaatacagggctcttccattaatcagtttttcaccatatttctcttttgagaatctacttggtccagaagctataacagatacaaacaaacgagaaatagtcttttctctctgaaactcgtcgtgtatttggagaaacaataagaaaagagacaaaatacaatgtaataagcaatcattttgtcatgcatggtattgattgtacttataaatagttacaagaacctaggaagactctagcccatactcctgaatccaaacccagcactcattctatggaaccacaaaccattgacagaaaaaacacaggcatcatgattcttagtcatgttgtcagaaaagatgaatgtgacatcaccttaaagttcctggatgattccgtagacctttctatcatcttggcagggtttgatcagatgatcagccaatgaatgactatctttttggcggcacttcccaggagttttttctaatcaaaatctcagactctcctagggacaaaacaggtttctacttgttgtctaagagccaataaggaatgttttaccaagcagttaatgggtttctttcatctctccatctcggctctgaattcccctccatagacaaagtctttgggtctctgtttcagaaattaccgtagggtagaaatctctgccaagccagaagacatttgcccactggaaagtaatgtaactggcttgaatttggtaaaagagtgaaggtttgagacaaaaacataccacttgggaaagtgataaaaatttatgaattgaattgtaaatcttgccattaagccaaccaaagagtaacaaaatctgaccaatctgacagcacatcagagttcttagcacagcaggctcaccatgtgtcatatacagccaggctaaagattgtattaaggacccccttaggtactctgaatttaaaataagtgtaataactcatttttaaacattttatatgatacttgaattattaaatattcacattacaaaatcagagaattttaatccattcaaaagggtgggttgtctaacactgaaagataatggtcatgtctagatagtaaaattacagtatatttttaacggatgtacatgttactttttgacaagacacaagtagtgaattttatcgtacaaattcctattgggtgattatgatacagagttttatttttgctaaagcaattactaatgtcatggctggatacctgtgcccattagtggctggttctgtgtttttttaggatggttattgatctcttgctgagctgagattcaggttttatgccagatagcttgattaatgggttggtttctataagtggactgaatggggatagaaagcaggggcagcctgctctgccaaccccaaatccgtcaagacgcatagctcattatgaaacagttatcaaggatacatgaaaaattaattgggctcagtttgattctgaaaagaatcggctttctacttggcgggcccccccgccccccttccactctttccagatgttctgcaccagcccctagagaaacagcaaagggagacgtattaatacattgtattgattagatcaagacccctgacagttatttgtagagataccatctggctgctgttcgaattccttcaccaaaaacaggacgtgacatgttattaatctcaactctctaagtatagacagttgccttttctgctaaaccgcattttaccattccgtaggagatggaggaagacctgaagggtgcagaaattaaggttattacacaaattgagccatatggtccaaatatttcagcaagaaaattgccaggcaataaaaattgctcctgccttcctaatggtgtaaattacagtttaaccatggctctaatgatgtccttctgccgcgcttaactactgttacatgaaggacattgttttaaaaatataaaaaacaagtaaatgccagcagcgtgttttacaatctgttagtgtgtcattaagaacactgtcagaattacataaacataatggcaggcaacccagcatacaaaggaactcgtatggaaatagaaagtgtcttgaaaactctcttcattatctctgaaatgtcaagagcactgtcccctctggaagttttctagggagaaaagacctgtccatctagtgctttattctaattctcatgtgtgtcccaacagcagtgttttctaaatcaagtgtcacaacccatagtgagactaagtacacatctggtaccacaaccctgtccatatacaaaaaatgaagcagacaaggtgaggagacagctaatgaattctaaacaaaatgatagacgttgaccttttgaagtatttttgtttttggggaaaacagttaagactccactatcttccttgatgatgacatcaacaattaaaagtataatttctatcctcagcaaactaacctggcaacagaaaaccaaataccacatgttctcacttgtaagtgggagctgaacaatgagaacacatggacacagggaggggaacaacccacactggggcctattaggggggtgaggggaggaagagcatcaggataagtagctaatgcatgtggggcttaatacctaggtgatgggttaataggtgcagcaaaccaccatggcacacgtttacctatgtaacaaacctgcacatcctgcacgtgtatcccggaactttaaattaaattttaaaagtataatttctgtcatccctatttggggcatgatattaagaggaagcttacttaagataatcaaaaatctttgggaattacaataaagaccattaatatttgagtaagacttgaacccttcaaatatttttagacctattacaccaaaaacacctcggcacttaaaaattccatataggtcatattgatgttttattctctaaaactgcacaatcctccaagctttttggtcttctaagatgttataaacacagtttgttaaaggaaaagtccagataaacgtttgtagaaaaatttgaagggaaaactacttttaattcccagaggagagttgccttatctttaagccctttttccttctccatttccccaaagggagaaagaccaggatataaattgccctttaaactaaaaaagaaaaaagagagggaaaaaacctaggaaaccaaaaaattattctttttgcatgcatgcattaatattaatgagaacccattaagttattatttcctcatggcacaaatggcaaggctagcaatctattgactagagcatcttctgcctggaaagctcttacccaggtgtccccatggttggctcccacactttcttctggtcttaagtgaaaagttactaccactaaagccttacctggcctactcagctacaatttcactccactctccctcacacacactttctattcctcttctgtctttatttttctctttaatatttagcttttatttctggtttcttgctaacctgtaatcatatttcagaaattgtttttcaaatgctttgttatgcttcttatttcacctaaaaggaaatctgtatgttcacagctaaatcaaactgagaaagcatcatttatatgttccaatttcaatttataagctgacaacttccacataaaacatattatgggcactttacacatgccatcttatttcacctcaataaccaatctgtggagtattattacctaaatttattaatgaggaaatggaaactcagagaggttaagtagcatacccaaggtcacacagctagctgcagagtttggatttgattgcagctctctcagcttctaaagccttttctttctgttatccagtattgcttcttgagtttcagcctagtggaacaagatgttatttatgaaaagctaaacatcaatgaaagccacaaattatagttcaataggacaaagagatgacacagagcttgatatgattcattgcctagtataaatatagaaaacaattgataaaagtttcaaagaattaaaagatcacttggactggaaaagttcagagaaggcttttgggagaggtctgtgctttgaacaatgggtgaaattcaaatagaagaaaagtagaacagatattaccttattcaggcaaagaaacagaagcctggttttgaaacatctgatggcaagtctctgcttcaggaggtcacatggggaatatttttccaatatgcccccattaattgggctgatattaaaacaactgatttaaaaaaaaaatcaaaatactcccaagagatgcctagcaaagctattgagtgaggtggttagcagcatgggtctggggtcaggaaacatagattagagactggctttggcttttttactcattgtatgccttcaggaggttatgcctaatagtgcctcccgcagagaggcagcacctcttagagtcgcaggaactgagacggcactcagtaaatagtggtgagtaagattcaaaataggttttcagagaagaaatcagcacatgaagatatcatggtgtcatagtgtgttgacagggtcctgtctggagatactagtccagaatttcaaaaaaaggaaaagttttcttctggccgggcgctgtggctcatgcctgtaatcccagcactttgggaagccgaggtgggcagatcacctgaggtcgggagtttgagatcagcctggccaacatggcaaaaccccatctctactaaaaatacacaaattagccgggcatggtggtgggcacctgtaatcccagcaacttgggaggctgaggcagggagaattgcttgaacccaggaggtggaggttgcagtgagccgagatctgccactgcactccagcctgggtgacagagcaagactccaaaaaaaaataaaagaaagaacaaaagaaaagaaagacaggaaggaaggaaggaaaatttattatattttcttgtttcccctgcattccctaatacccctttcccaaaagtatggatttcttcactaaatatgttagtagcagaatggtcttgtggcagttgacccaagactccaggtagagcagtggggaaagaaaagacaaggccagccaagaggccagccaagaggacaagctcctccaaaggttgacttgagatattaaactcattgaaaaagttactcaacatccacagtgttctggtggtacctcacttagtcctggacaatgaatcacagcccaagcttcatcattgaattggtgacactgccgagggccaactcaccagccttcaaaaacgacagtgctgctgacagcaaaggcgatgaggacacacatgtgcatccacccttgagatgctaaaagaggcaggaaagaacttgagggaaagaacaaatcactcttctgagattgtcctataaactttataccaggacctatgctatcatcctccttacctaatcatgtttaatatctgatttataagaatctaaatgtgtacctaaaagtagctttctaaatattactgggccacattaaactgtgaccaattttcttccttcctggcctaccacattttagaaatatgatagcatatttgggttgggagtcgctaaaggcctcaagagagtccatctctttgtcctttctgactaggaagacctggtcatcacgccacaagccttggtgtctcgtttttaacagagcaataattatttattagtggaatatatgcttattatatccagaaattaaagttgttaggggacatttgtgtatccaggtccctgtggctgggtgatcgcatctgttagaaataaatcactttaagaaaattatattagccccacagacagtcaagaatggagcaaagggagggaagtgtgaatagggtgaggaagcttgattttaaatcttgtgaaatagagtgtggtcaatatgttgtcagcacattacagtgtgcagacatcaactccatttttcccctctttgaacctcaggtggccaattaacagtatatgctatttattcattacaaaacaggcaggacaaattgaatggttagaatgactaataagaattcttagcaaggagtaaaataaaaaatgatacataaggagagaccccccagaaaaactttagggatttccagaaaaaaaagtcttgaggagttttcctgttaaatgtatctagaatttctactgacatgaggaaattaaaatggaaagattctctttgaatacattttcttcctaaaatatgttctcttcaattccctcatttgtatttccttagagtttcattccttcctaaagcagaaagacagttttaaattacttctagcaattataagtatcattagggtgttttgatgctgcatttttacaacaagcactgtgcttgccttccttatttgtctctcagttcaactccaagtcgcaacacaggaaatgaaaaccttgtaaattgacttgatcttatgaatactcacttttgcaaatatgaaagaacttaagaagggattataaaatactccttatctatataattaaaattcagttgaaatatatgaattcaatattttaattcatgcatttcattttgcgggcattcaaagattatatgcttctatatgtctgccattgatttctgtaaataacattatctctcttattgcaaaacgtacatcagaagaagttggaagaaagcgagggcttgagggatgttaaactgaagcagcagtgacttactatgcagtgttagtagattgcttgccttgaggatctagaagccgatagaagaaatggagccagcaaataagaaatttcttatttcttattccagaaataagaaattctgaacttttaccttcaaagatccaaaaagaacatgctaatgttcttttttttctaacttttgagtaatttagtcattctcgttcagaaaattaagggtctacatctggcagcaactgaaataaatggctcaattgagtacacacttgaatgtcaaatatatcactttaaaagtcaatatttgtttcagctgtaaatgtttctgaacggaaatgatgcttttagtgtctgtagtctaaggagtagttttatttttgaaccctcaaattgagtgctccacctagagccgtaggaccctttcctttccatgaggagagcgccctctactgggtatgtttacttaccacgcatgactgttaagaccctgagctaaacgtatgagcagttgagatgtacataagaaagagtttttggaaaatctttgcccctgcttgtactagaatgattgcaagtgtggaagtagccatagttcactgtagttttctttttactgctgtattattgcaccctgttgggggatacatctgagcatttcatgtgtcctacttttaaaatgcccagatggtggctacgtgctttggtttgaattgggcagccctcatctttcatgctctgtagtctgcctcgttatcagagagacatgagacaaggaaaattcttccatttttcagctcctcttcatctgtttctagtcacccacagtgaatgatgcacttgcacaattgttaaaatgacagtcactgtgataactgaacatcacttccctgggatggggagttccctatgtacccatagcttcttgattccttcccaatacagcacctttttcagtgtaactgatcacttgcaatcttgtaagtaacacagcagtgagaggcagtgtaaatattttataccttgccccaatcacttgtatgtgcatcggtcttcttcactctagcctttaagcttaacagagattttaaatcaaatcattcaaccctagaaatagtcaaaagaattaataaaataaatgaaacagtgtaactggttaaaatagccccagtgcacaatacaggtttagtatgattttgtgacatacacattttatagggcttttgtctccaactacattcttcaaagagccatctgggcaatgaccataggtatcatttttaccaataatagtcagcacttcccactgggaaattagtcaagggaatgagtttttttttttttttttttttttttacaaattatcttcaagcatctatcttccaaaaagtattactggactttgtccattacaaggcaacaacctaagtgagttacttgtgctcttattttagaactttattcatcagatcattgtgatcaaactcaatttcattttcaaagaggaaaaagattttgctctgtttttcttcttaataataggtttgctgaaggaagaacattaatacaggtcagcgatctccaaactttttagaatattcacttgtagaaataataatttggggagcacacatctgcataatatgtatatttacttatttgtaaattataaaatatgtactagttaaatagtatcatttacactatagaaatagacatttttaaaggagtggaaatagataaaattatcaagaaaatattttattatgagcaactactatcaataatacctcaaggcacaatacacactgaaagattaatcattaatgatgctgaatgtcaatctctttcctgagtgttcttgatcatttcaaaattttgttgacacttctgatcaaatacaattggaccattcatgtttatacctcatgctgtggttgataaggagcttgaaggaaggagaatcagactggccatttatttgttcttcatttatgtttgtattgttagtgttatatttgaatcataaatttgaattctaggaattttgaaagccattcatgtttccaaagttagtatacttaaaaccagataatataatccataaacccccttagcatagaaccataaactacaatatgtcacttgacacaaggggtccagaaccccggggacgcagaccagtactggtctgtggcctgttgggaaccaagccacacagcaggaggtaagtggagggtgagcctcaccacctgagctccacctcttgctgtgctccacctgaggagtggagcacagatctgctccacagatcagctgtggcaattgcttctcacatagcaaaccctattatgaactgcgcacgcaagggatctaagttgtgtgctccttatgagaatctaactaatacctgatgatctgaggtggaacagtttcatcctaaaaccatccccacctcccccttccatggaaaaattgtcttccatgaaacggatccctggtgcccaaaaggttggggatcactgctttgcactaaaagcaaacaaatagatgaatattgttagctcctcgctgtaaaactcccattcttccttttccaaggacagatacagaacttaattgattcattcattcactcatccagtcagtatgtgtatgcatctaatatatgccaactgggtatatgacagtgaataaaccagacaaaaatgcttccctcttgaagctcttactctagtggggagataaagacaataaacaagataaggaaataaaatatatacataccatacataagctaagggcaatggaggaaaataaagcagattccagagtctccattataaaaaatacaacttttgcaaattggtctttagttcttattgagtttaaaaggatgtttcccttccacatccttcttcccactgtcttctgggatttttgcttcagatatgatggtcaaattgcttattataaattcccttctaagattctatgagttttaaatttgttttaattgttcacatgttgcattgaatgatgcaattgtactcttctagcacacagagctagtaaatttcctatatattgatatttaaagcctgtccttttatggagtattttgtgaccacctaaacccatgatgatttcttgtgtatacaccttcagtgcttggttcccatgtatttctctagtggtttcagaaaggtgagttttacattcctaatggattacagttcctaaaatccagtatgttcatactttctacttttattcctttccatttagtgcctagaaccatgccagaaaaagacataatttgactgtggatttaaccctcagatcacaaaccaatctcagagctttatttttttgctgagagttttaaataaactataaagtcaaatttaaacaattatcctttggaatcaacagaaccccacatttccttagctttccttagctgttcctattcccaaggatcacattcagagcactcttcttgagtgacagtgatgtgccaggtacttcacagaggtcatctgttttaattgtcacaaaagcccaagagaaagatactaactgttagaaatctagctcagaaaaagtagatgatttacctaaggtacatctagtgtgagtgacaatcagaacttaaactcaattcttctaagttgactgctgttttgattaaagcgcctgggctctcagaagtggactcttcctgggtgttagtcacaagggcttctcagaatttttctcctacatatgagacagcagatcatttctgcctctctgctaagataagccaagcaaaataatagattgtagaacaattaataatgcattcaaaatgccaaactcagcacactttctatcctttgtgaaaaattttgttcccattttgtccaaatgtctaataaaaatgattgtggaaaaataaaaacaatctttgatctgcctaaatgaaaataagaaccacaacttctagctctcagaacaaatcaaagttgtttttatttttaattaagtatgctaagcttaagtacattttctcttaaggtgtaattactaaaccatgatgatttctttttgtttattcatttaaaacacaaataaaagcagataatcaatagatcataatctaaaactagaggatttacaagttaataagcttgagtcaatagatattccataacaaagctttcaatgctgaacctgacataatttgctttgcactaagctggttgacttaatgctttaatttaattccaatattaactgaaaaatccaaagaaaaggggaaaatttaaatcctattatactgaaatatgttcaaagcaacaactcaatatcctgccacaactgcttaagtgtgccaccaaatgtctgcttaatcacctggtttctgattggtgataaccagttaacccgtttggagcctggtacaagtgaattgtggaagtttctcagtggtccattcatgcaatagcttttatcttagcctcaacagtcatcatattttcatctcataatgtctacttttcctgacttatggccaaattattggagttgtttttatttgaaaagcaatttctccttgtctcttgagattaccatccagcctgacctcccaaaaagcagaacagtaggcaggcctaggtcaaagaacagaagaaagcctttcttagttccctgaaaggaagatgtaagaagctatctgtatgaagaaatagcattagatggcatccatcatgcaaagtctggtagtactagtagaggtagtgagagggatgtgaggcaatatccagcataccttcaaggttatgagcacagactcaaaagacaggatccccccaggcaaatcctggttcttccccttacaattatatgaccatggacaatgtgcttcgactctcttttcatccatttccttatctgaaaaatgagggtcataatagtgtctatctcataaggttgttttaaggcttacacaatttaatatacataaagtacttgaaaagcactcattgttatcatcctttgagatactcttgaggcataaggaacttatgctaagaataattttgagaacagcagcatcagtcactgaatatagtagtcagatgtgtctttcagaagagttatgtgtgcacggccaaagtcctaaatattccatttgttaccatccttaaaatatcatttgtgaatttgtaactggtttttgctttgtgtcattgctggtcgactgcagtcagggtggcagtgttttggctgccccctaccatctttagttttctggtcccattagtgttgtgaccaagaacaagttagtgccctttgctcaagtaaatgggctagaagttaagcactgaccttttaccataggggacccttttctattctgaaagagaacttagaaaacagaacagaaatctcattgatttttacaatgcacattttttcatatttctccgtctctgaaattgcatgcatctaacaatcttataatcactgtagatggcagttgttacatacttgtcatttcctgtgcctgcacaaactctcgtcacttcacttgagttctgtgcaccgttggtacgacacacacattgagtttaattgccacttaaaatggcttcaaaaaatcatactatgatttggcattaaaataaaaagtatacacaaaaggcacagaaacagtcacttcatataaaacttaaaaagaaaaaacaaactatgcccatgcaagtctaaagaagtctttcaataagtataaaatacacatctaagtgataaaggaatcactgtgttcttgttgaattagcagcatatttttctctttcttagggatacataaaatagtttttaaaaaaataacagtgtgtttaaatagatgaaatcctggaccccaaaaataggtgtgttttataataaatatttttaaaacagctagcatattgccaataagataatgtatttaaataaaagataatttattcattccgcagacatctatagagcacccatatggtgccaaacatattttgtatccctagtccctgtcctctaagagttcaaggtctagtggggagaaaaggcaggtaaatagatcaatctaatataaaaatgccataaacagcagaaagaacagagaagagagacaagtaactcagtctggggagtcaagacactcttccaaatggagatgacattaaatttgtattttcaaggatggaaatacatcctttccaggcatagaagggcattctaagaaaagaggaaatcatgaacaaaagcgcagcctcattgaagagtgtgttgtaactgggtctgagtcatgagtctagggacagggtgtgaatgaaagaggcagaccagggagaggctaaggatgtgcccaaagagacaggctgcaggagattttgctggtaagggctggcaatcaaaaccaccctgcttcctaaccaggtctaggctctggcatcactctgacttttaaattaggaaagttagagcttgattcttgcacttgactctgtcaatgcattaggatctaggagagatggtaagtgatgttggaaagcagtccaaagttcataagcagttagctatttccatccaaggatgccatgatttcctctcctgaaactaagtgaacagccatgggtaaaaatgaactgaaggcagaacatgggcctctcatgtaaaagcagaagtaggggattcccaggcaagatggccaaatagaaacagctccagtctgcagctcccagtgagaccaacacagaaggtgggtgatttctgcatttccaactgagatacccggttcatcccactgggactggttggacagtgggtgcagcccatggaaggcgcagaagcagggtggggcgtcgcctcacccgggaagtgcaaggggtcggggaactccctcccctagccaaaggaagccttgagggactgtgccatgaacgactgtgctatctggcccagatactacacttttcctacagtcgtcacaacccacagaccaggagattccctcaggtgcctacaccaccagggccctgggtttcaagcacaaaaccaggcagctgtttgggcagacactgaggtagctgcaggagtttttttttccataccccagtggcacctggaaccccagcaagacagaactgtccactcccctgaaaagggggctgaagccagggagccgtgtggtcttgctcagtggatcccacccccatggagcccagcaagctaagacctactggcttgacattcttgctgccagtacagcagtctgaagtcaacctaggatgcttgaccttggttcggggagggatgtccaccattatggaggcttgagtaggtggttttcccctcacagtgtgaacaaagccaccaggaagtttggactgggcagatcccaccacagcaccgcaaagccgctgtagccagactgcctctctagatttctcctctctaggcagggcatctctgaaagaaaggcagcagccccagtcaggaacttagagaaaaactcccatctccctgggacagagcacctgagggaagggctggctgtgggtgcaacttcagcagacttaaacgttcctgcctgctggctctgaagagagcagcagatttcctagcacagcacttgagctccgctaagggacagactgcctcctcaagtgcgtccctgacccctgtgtcttctgaaagggagacccatcccagaaggagttcatagacatctcatacaggagagctccagctggcatccggcaggtgcccctctgggacaaagcttccagaggaaggagcaggcagcagtctttgatgttctgcagcctccactggtgatacccaggcaaacagggtctggagtggacctccagcaaactccagcagacctgcagaaaagcgccctgactgttaaaaggaaaactaacaaacagaaagcaatagcatcaacatcaacacaaaggaagacaatgaaacaaccccatccgaaggtcaccaatatcaaagataaaggtagataaatccatgaagatgagagtaaaccagcgcaaaaaggctgaaaattccaaaaactggaatgccttatctccaaaggatcacaactcctcgccagcaagggaacaaaactggacggagaatgacttcgacaaactgacagaaataggcttcagaagcaaggtaataacaaactcctccgagcaaaaggagcatgttctaacccaatgcaaggaagctaagaaccttgaaaaaaaaggttacaggaactgctaactagaataaccagtttagagaagaacataaatgatggagcagaaaaacacagcactagaactttgtgaagcatacacaagtatcaatagccaaatcaatcaagcagaagaaaggatatcagagattgaagatcaacttaatggaccagtgcaagaagattagagaaaaaagaatgaaaaggaacaaacaaaggctccaagaaatatggggctatgtgaaaagatcaaacctacatttaattggtgtacctgaaaatggcaaggagaatggaaccaagttggaaaacacacttcaggatattatcaaggagaacttccccaatctagcaagacaggccaacattcaaagtcaggaaatacagagaacactacaaagatactcctcaagaagagcaaccccaagacacgtaatcatcagattcaccaaagttgaaatgatgaaaaaaatgttaagggcagccagagacaaaggtcgggttacctacaaagggaagcccatcagactaacagtggatctgtctgcagaaaacctacaaaccagaagagagtgggggccaatattcaacattcttaacgcaaagaattttcaacccagaatttcatatccagccaaactaagcttcaaaagtgaaggagaaatgaaatattttacagataagcaaatgctgagagattttgtcacaccaccaggcctgcattacaagagcttctgaaggaagcactgagtatggaaaggaaaaacttctaccagccactgcagaaacataccaaaatgtaaagacgatcaacactatcaagaaactgtatcaactagtgggtaaaataaccagctagcatcataatgacagaatcaaattcacacataacaatattaaccttaaatgtaaatgggctaaatgccccaataaaagacacagactggcaaattggataaagagacaagacccatcagtgtgctgtattcaggagaccaacctcacgtgcaaagacacacataggctcaaaacgaagggatggaggaatatttaccaagcaaatggaaagcaaaaaaagcaggggttgcaatcctagtctttgataaaacagactttaaaccaacaaagatcaaaaaagacatagaagggaattacatagtggtaaagggatcaatggaacaagaagagctaactatcctaaatctatatgcacccaatacaggagcacccagattcataaagcaagttcttagagacctgcaaagagacttaaactcccacagaataatagtgagagactttaacaccccactgtcaatattagacagatcaacgagacagaaaattaacatggatattcaggacttgaactcagctctagcagatctaatagacatctaacagacctaatagacatctacagaattctccaccccaaatcaacagaatatactttcttctcagcaccacatcacacttattctaaaactgaccacataattggaagtaaaacactcctcagcaaatgcaaaagaatggaaatcataacagtctctcagaacacagtgcaatcaaattagaactcaggcttaagaaactcactcaaaaccacacaactacatggaaattgaacaacctgctcctgaatgactactgggtgtagaatgaaattaaagcaaaaatacatacgttcattgaaaccaatgagaacaaagatacaacataccagaatctctgggacacagctaaagcagtgtttagagggaaatttatagcaataagtgcccacaagagaaagcaggaaagatctaaaatcaacaccctaacatcacaattaaaagaactagagaagcaagagcaaacaagttcaaaagctaccagaagacaagaaataattaagacgagagcagaactgaagaagatagagacatgaaaaacccttcaaaaaatcgataaatccaggagctggatttttgaaaagattaacaaaataaatagactgctagctagactaataaagaagaaaagagagaagaatcaaatagacacagtgaataatgacaaagggaatatcgctactgatcccacagaaatacaaactaccatcagaggatactataaacacctttacataaataaactagaaaatctagaagaaatggataaattcctggacacatacaccctcccaagactaaaccaggaagaagttgaatctctgaatagaccaataacaagttctgaaattgaggcagtaattaatagactaccaaccaaaaaaagcccaggaccagaaggattcacagccgaattctaccagaggtacaaagaggagctggtacaatttcttctaaaactgttccaaacaatagaaaaagaagaactcctccctaactcattttataaggccagcatcatcctgataccaaaacctggcagagacacgacaaaaaaagaaaatttcacaccaatatccatgatgaacattgatacagatattctcaataaaatactggcaaatcaaatccagcaacacattataaagcttatccaccacgatcgggtcagcttcatccctgggatgcaaggctggttcaatatacctaagtcaataaacataatctatcacaaaaacagaaacaatgacaaaaaccacatgattatctcaatagatgcagaaaaggccttcaataaaattcagcaccccttcatgctaaaaccactcaataaattaggcattgatggaatgtatctcaaaataataagagctatttatgacaaacccacagccaatatcatactgaatgggcaaaagctggaagcattcccttggaaaaccagcacaggacaaggatgccctctctcaccatttctattcaacatggcattgaaacttctggccagggcaatcaggcaagataaagaaataaagcatattcaaataggaagagaggaagtcaaattatctctgtttgcagatgacatgattgtacatttagaaaaccccatcatcttagcccaaaaatgccttaagctgataagcaaattctcaggatacaaaatcaatgtgcaaaaatcacaagcattcctatacaccaataatagaaagagagccaaatcatgagtgaacttccattcacaattgctacaaagaaaacaaaatacctaggaatacaacttacaagggttgtgaaggacctccccaaggagaactacaaaccactgcacaaggaagttaagagaggacacaaacaaatggaaaaatattccatgctcatggataggaagaatcaatatcctgaaaatggccatactgcccaaagtaatttatagattcaatgctaccccatcaagctaccattgactttcttcatgaaattagtaaaaattactttaaatttcatatggaaccaaaaaagagcccatataaccaagacaatcttaagcaaaaagaacaaagctggaggcatcatgctacctaacttcaaactatactacaaggctacagtaaccaaaacagcatagcactggtaccaaaacagatatatagaccaatgaaacagaacagaggcctcagaagtaacaacatacatctacaaccatctgatctttgacaaacctgacaaaaacaagcaatggggaaaggattccctatttaataaacagtgttgggaaaactggctacctatatgcagaaaactgaaactggacccctttcttagaccttatacaaaaattaagatggattaaagatttaaacataagacctaaaaccataaaaaccctagaagaaaacctaggcaataccattcaggacataggcatgggcaaagaccttatgactaaaacaccaaaagcaatggcaacaaaagctaatattgacaaatgggatctgattaaactaaagagcttctgcacagcaaaagaaactatcatcagagtgaaaaggcaatctacagaatgggagaaaatttttgcaacctatccatctgacaaagggctaatatccagaatctacaaggaacttaaacaaatttacaagaaaaaaacaaataacctcatcaaaaagtgggcaaaggatatgaacagacacttttcaaaagaagacatttatgcagccaacaaacatatgaaaaaagcctcatatcactggtaattagagaaatgcaaatcaaaaccacaatgagataccatctcacaccacttggaatggtgataattaaaaagtcaagaaacaacagatgctggagaggatgtgaagaaattggaacacttttacactgttggtgggagtgtaaattagtttaaccattgtggaagacagtgtggtgattcctcaaggatctagacccagaaataccatttgacccagcaatcccattactgggtatatacccaaggcattataaatcattctagtataaagacacatgcacatatttattgtggcactattcacaatatccaagacttggaaccaacccaaatgcccatcaatgatagactggataaagaaaatatggtacatatacaccatggaatactatgcagccataaaaaagaatgagttcatgtcctctgcagggacatggatgaagctggaaaccatcattctcagcaaactaacacagaaacagaaaaccaaacaccacatgttctcactcataagtgggagttgaacaatgagaacatatgggcacagggaggggaacatcacacactggggcctgtcaggggctggggagaaagaggaggggtaacattaggagaaatacctaatgtagatgacgggctgatgggtgcagcaaaccagcatggcacatgtatacctatgtaacaaacctgcatgttctgcacatgtatcccagaacttaaagtgtaattaaaaaataaataaataaaagcctgggtgtggtggatcatgcctgtaatcccagcactttgggagtccgaagtgggcagatcacctgaggttgggagttcaagaccagcctgaccaacatggagaaacgccatctctactaaaaatacaaaattagctgggtgtaatggcacatgcctgtaatcccagatactcgggaggctgaggcaggagaattgcttgaacccgggaggcggagattgcagtgagccgagatcgtgccattgcactccagccaggtcaacaagaacgaaactccatctcaacaaaaaaaatataaataaaaaattttttaaaagcagaagtaggattacagaaagcagagaagcccaaaagatttgaatgttcactgacaaacacagcaataaagtatttgatattgcaggcttcatttgaagtaaagcttcaggaatacctggaaaccaagctacaggtggcactcagctccctaaccagcctttgccaagaggaggggtctttccagagacaaccatagagagtaatctttagccatgttatcgtctaatatcaaaaatagggggcaggccaggtgaggtgactcacacctgtaatcctaacactgtgggaggccgaggcaggcagatctcttgagcttaggagttcaagaccagcctgggcaacatggtaaaactacatctctacaaaaaatacaaaaaaaaaaattagctgggcctggtggcacatgcctgtagtcccagctacttgtgggactgaggtgggagaattgcttgagcccaggaggtcaaggctgcagtgaacagagatcatgccactgcaccccagcctgagtgtcaaagtaagaccctgtctcaaaaaacaaacaaacaaaaaaaaaagagggtgtaatggaagtgttttaatatgaccacggcatcctctcactgagatctgctaccatttattttattttgtttgtttagagacaggtctcactatgtcacccaggctggagtgcagtggctccatcatagctcactgtatccttgacctgggctcaagtgatcctcccaccttggcctcccaaaatgctggttagaggcgtgagccaccatgcccccatttgtaatttaagctgataaatgagagcaggggcacaagtctgtatccgctaactcttcagcaacagctgacccaaggccagcaaacccattgcatagccaacaaccaaccagatcctgtctttctgaagacacacagagacagtagtcagatggttatgactaataaggctgtaaggttgtttagactgacaattggtagccatgctgggcaaaagggaaagaaagaaaattaagagaaagggaaaagagagagaagtgccatgcagcccctgagtgacagagagagaaactcagttctgacagttttccagtttcaaaacccaaacctgtaaagttgacccttgaacaacacaggtttgaacaggtccacttacccatagcttttcttctgcctctgccactcctaagacagcaagagcaattcctcctcttccttctcctccttgacctattcaacaagaaaatggcaaggatgaagacctttatgacctttctcttccttatgattttcttaataactttttctctagcttgctttattgtaagaatgcagtatataatacatataacaaacaaaatatgtgtttgttgacagcttatgttgttggtaaggcttctgttattagtatcctgttagtagttaagttccgggggagtcaaaagctatgtgtaggccaggcacagtgggtcatgcctgtaatcccagcactttgggaggatgagacaggcggatcacctgtggtcagaagttcaagaccagcctggccaacatggggaaaccctgtctctaaaaaaaaaatacaaaaatttgggtgtggtggcacacacctgtaattccagctactaggaggctgaggcaggagaatcccttgaacccaggaggcagaggttgcagtggccaagatcgttccactgtactccagcctgggcaatagagagactctgtctcaaaaaacaaacaaacaaacaaacaaacaaaaacagaaagttatgtgatatgtagacgtttgcctgtgtaggacattggatcccctaacccttgcattgctcagaggtcagctgtagcttctgtacaggcttgggttctatacttgccttttctcttccttacaaaaccaatcaaaatgagtttcttttccctgtaactaaatttccttgactagaatattgattactgccaattcccacctttcctgtaagttgtaagttttagaatctggttgtttttttttattgggaaatacaattgatttttgtatgatcctaaaattgctgaactctataattgtttatttttagattctgtggaccttttaggtagttaataatcatatctcatgcttcaaaacccatgtaccttgtgttagaataagataggataggataggctctggtaacaaataaaattccaaatctcactacctaatgcaataaaagtgggaaagtcaaaggtggatttggctgcccttctccatcttatatcagtgtcagatcatgataggggaagagcatgctgcagagttctgcaagaagcttttaaggtccagacctggaaatagctgacattccttcttctcacatcccattgataagaatgtctcataacctctctatttaggggcagggaaactagcaactgcgaaaaaagtaaaataaatgaatatttggtaaattataataatctctgctgcatagctctttttatttccttatcttacattgcctaggattaccactacaataataaatagaatgcatctgtcttatttgttatattaacaggaagactgctaaagttttatcattaagtatgattttgctatatgagtgctgaatttttctcttgagatgattaaatgtaaaacaacttttctaagggctaaatcctatatggtcattgctctggactgaatgcagttgcccactccctttccaaatccttacaatgaaatcctaaccctcaatgtgatgttattaggaagtggtaaggggacaaacaagtgaagagacagatacactagagtataagatctatcaagtaataaaggtggacctgtgagtaaattcaaaccatttttctctcttgagtagccatgcttatgacaaagaaattttgaatgccttgtgggttgtttgtttgtttgttttgagatggagtctctctctgtcacccaggctggagtgcagtggcgtgatctcggctaaccgtaagctccgcctcccgggttcacgccattctcctgcctcagcctcccgagtagctgggactacaggtgcccgcaaccacgcccgtctaatttttggtatttttagtagaaacggggtttcacagtgttagccgggatggtcttgatctcctgacctcctgatctacccgccttggcctcccaaagtgctgggattacaggtgtgagccaccacgcctggcaagaaattttgaatgtcttgttttcaacaaatagttttaatttaaatcgaaaagagtgtgtaggtatgagttgcgaatttgtaattcatttgcgattctggtattgatggattgtcttatcttgtacaggtcatttgggccctatggactttaggctcaacaacaaaatcagacagttggagtacagtgccagtcacaatttttagactgtttaaccctaaatgtctttctaataggccttatttatatgagaacattttatagttaaccacaaatattttgtctgtgtttatcaagagttacaagcatagcagccctttctttactgaataaaagttcaaacaaattggattcatctttatttggagctgccaattaaagtgggatatagtatagttaagcagtactcaacatgtaggccactaatctcttagggtcccaaacactctttcaggggctctgccagggaaaaactatgttcatactaacagtaagaacttacatgtctttttcaccttcatccccttcatgagggtacactacagtggagttttccagaggctccatgatgtatgaggatgtagtcactctgctggctagtcgtatacatgtctcagtattcttttcctttaaacacttctctactttaattttcaatatggtactattgatcgatataaagatcagaaacaaaagttctttgggatcttcagttgtttttaagaaacaggggtcttgaaatgaaaacactggaactactaatacacttcacaagtacattttacctccacatagcacagaaataaaatcataaccctgtctcttgtcagcagtatgactctaggtaagacatttaacttatctaagcctcaatttccttatgtataacaatacaaatctcctagcttcatgtgaagatgaaatgggatacaccaagtctgacatagtaggagcaaaaactttgctcacaaataatctaccttaggaaggatagacaagaaaatggtaaactggttgggtgcagtggctcatacctgtaatcccaacaatttgggaggccaaggcaggtggattgcttcagcccaggagttcaagaccagcctgggcaacttagtgagaccttgtatccacaaaaaaaaatacatatgtgtgtgtgtgtatatatatatatatatacacatacacacacacacacacacatatatatatatatatacacacacaaaaattagctgggcatggtggcacacacctgtggtgactcaggaggctgaggtgggaggattgtttgagtcttggagacagaggttgccatgagccaagatcatgccacaatactccaacccgggcaacagagtgagactctgtctcaaaaaaaaattaaaaacgaaaagaaaatggtaaataaataacttttgttaccataagggaggagaactaaacaactggggcatgggggaggagatggggaacttttcattgttgctgcacccttcacttagaaggtccagtttatgaaaagtaataatttagttaaaaccttcaaaaatgatttttaaagaatttccctgctcctcatagatatagcctggtagtttacataccacttcattttctatgaagtactgttgttgcaaatttatctatgcaaagagctaagcatgcaatgattgttgctgtgggtataaaatactgctttgctaaggatactgtagctaactcacagttaattggctgaggcctgagcacacccatatcagtttgccatatacagatttttggttaacttgatttccatatgcaaagtgagaagaaagttctaattcatatatatatatatatgtaaaatatctttctctcctgagtcatcaatctctacctcattattgaaaaattgccatcaatataaaaatatactcctggtatctcccattttttaaatatgtgactccacgggcccctccagctaccatctcctgttcctgttcccctttacagtttacagccaaacttctcaaaagaatatattactattccctgtttctacctctacacatctgttctcccttccacccactccaaccaggtttctgtccttatcactccattaaaaggctcatatcaagacgatttgccacgaaatcaagagctcttcctatgcacagcttccttaacatttcagcagcatttgacactgcttaccacacttctttaaaaaataccctcttctctcagtttcaaggagaacacactgtattggttttcttccctttattgtcctggtctcagcttctattactgatttcctttcggctgctgtccaagtcagcctcatcctgcatctgccactgagtttggtcctgagctctctcttctacttgacctacactctctccttagactattcctagactcattcaagtctacttcttagacttcactctacattcgcttcttcaccccagcccttcagcttaaattctgtccatattcactgataatacaaatacttttgaacacttactctagcccagccacaattagaggcatttggggtttagagagaatgaagtagatgcaggcctttgactctgtggagtttacattctggcaaggaaagacagacaacaagcaataatcataaaaaaatatggtatgttagaaggtgatgagtgcttaagaaaataaatcaggataaaaagaatcaaaattgggaggagacagggaggagagtgggtcagttgcagttttaaagaagagtggctcattgagaagatgagctgaagttactcatgcaaacctatgcataaagtgggttgcaggcagagaaaacagccagtacagaggcctcaaggcacgagcttgtttagtatgttttaaaattttcaacaagactagtgtggctgcagtgcagttttcccaggggaaaatgataggagacaatgtcagaaaggaagtggaagggtgggcagaaagaacaggctttgattatgaataacttgaggaactagaacagggttttgagcagaggagtgacatgatctgacttgtgtccaaaatacacttttgctatgtggacaatgaggatttaaggttaaaaataggctaactggctgggcacggtggctcacacctgtaatcccagcactttgggaggccgaggagggcacatcacaaggtcaggagttcgagaccagcctggccaatatgatgaaaccccatctctattaaaaatacataaattagcctggcctgttggtgcttgcctgtagtcccagctactcaggaggatgaggcagaagaatcgcttgaacctgggaggtggaggttgcagtgagccaagaggctgcactccagcctcagtgacagagcgagattccatctaaaaaaagagaaaaaaaggcaaactgaggctactgcagtgctgagagtgggaaagtatggcttggatcagagtggtagtagtagatgtggtgtgaactggtaggattctggatgtatcttgaagttaaataaatccagtcctatttcctaatgagtagagtagatgtgaaaaaaaagagaaaatgaatccaaagtttttggcctaaacaactggaagaatgaagtcgtcatcaactgaaaaaaagggaagactgcaggtgaagcagcttttctaggtacatcagaatcatttcagtcagggagactgaacactatgggttttgagatagaaagtttattattattgttcattagagacagggtcttcttatgttgcccaggctacactcaagcttctgggctcaagcaattcttccaccttagccttccaaatagctgggactgcaggtttgcatcaccacacccagctaaagatgagcgctttctctaggaattagaccttacgcaattgtgggaatagctgggaaagtgaagatttggggaggagagtaagaagatgggtaagggagttgccaccatgcccattcaagaagccaaggatggccagccaccttagtgtccctaccacagatgcctatggagaggtctatggaaagcaactcctctgtttagctaccatctctgtggggccagcactaagtgtcaggtggtagacctgggccactattggttaaagagtcagcagctggaaagaagagtcagattggagtagaggagaatgaggacaatctggaacccacttgcacctctgtgtctattcatcttcacatctaacttcaaccaacttcgaagagtaatggccactgatttactttcattctccaaattgtatgtaaatgtatctttaatccagaactagatagagaagatatattactgctatatataacaaagtacaacaaacttagtagcttaaaaacaatttctacttgttatctcacagttcccctttgtcaagagtctcaggccttttgttcgaggtctcataaggctacaattagggtgtctgttgggctgtgttctcatccggaggtttgaatggagaaacatttacttccaatctcattcaagttgttagcagagttcatttctcttgtgtgggaatgagagggaggccctggcttcctgttggctgttggccctcatgtcctagagaccacctagttcccctccacaggggtccttcacaggccctctcatagcatggcagtttacttcttaaagaccagctgaaggatttcactttcagtctgctgagatggtgtctgccatatttatggcagtgacatcctagagttttgccattttctattagttagcaacaaggcataggccctgactgcactcagggggagggagaatcacacaagggcatgattcattgcaggggtcaccttaaggtgtgtctcccacagaaggaattctgagatatgcagtttcaccttaaccaatctgacataatacaaacttcaaaaaagggaaaatcaagagatcatatggagacttgttaagtttcagatgtattagacatccaaatgaagaggttaacaagacaattggatacaagactggattttgggagatatgtccaaggaccctcaaatgtgtattcctaattcagtctcttcccaaaactatagtttcattggtctgtctacttgacatcttgaacttaacaagaccaaagttgttccttcccttcccaaatctgttactgctcagacttctacatctcattaaatggtaccctcacctaccctttctctcaagaagaaaaacctaagagtcgtccttcattcctctctttcccttgccttctacattcaatccatcataattctattggttctacattcaaaatataaatctatccccttaattctatgtctaccattaccaccctagtccaagccactattaccccttcctggccttcagcaaaagcctttgaatgtctcccctccctctcttgacccatgttatgaaatggattgtgttcctcccaaaatgcatacactggagccctaacccccaaggtgactgtatttggagatagggcctctaggaaggtaattaagcttaagtaaggtcataaagatgggaccttcatcctataggattaatgttcttataagaagaagagacaccagagatatctctctgcatgcacacaaagatgacacggaaacacatccagaagacagctgtctataagccagaagagaggcttcaccagaagccaaccatgaagacaccttgatcttagacttctaacctcaagaattgcaagaaaatgaacttctgtgtttaaagcaactcagtccatggttctttgctatagcagcccgagtagacaaatgcaatggcctccatatattgttcacacatcagccagaatgagttcttcaaaacctagattaaattgtgtcacacccttgtttacaggccttcgatagttttccactgaaattggaatcagacttgaactctttaccttggcctccaggattgataccatctagctcctgctcatccttttgaccttctcttgggccattcttctctccatcacccagcttggtcgcactagctcctttctgtcaacaaaaacaccaagtctgttcccatcttagagtttctgttctgctcttgctcccaaaactttgtcccctgattcttcacacagatggtgtttttctgcactcttgcctaaatgtaacttcttcaaggacctttcttacccgcccttgtaatcaagaatttcattcactcttccccaatacctaagcccaaacactaattagtgcaccaccctacttattcccttcataatttaccacaatttccaattctctctctatgtcttgatctctctatctccctctgtttatatattgcccatttgtcctcctttataatgtaaaattcgggaaggtaatgaccttgcctcccttgctttctattgtatcctcagagattaggagcatgcctagtgtataagaagctctcaatacatgtgtgtttaatcaaggcttaaataaatctaaagctatggcccaaatgaaaatttttatatgagttttagtacagttttgccactatttccatagaatagattatcagagtgaaattgctgggtcacagtgtatgcacatttttaattttgatagatcagaagtactgctttttaatatttagtgtgactgatttgccactttaaaatttaattatcacaaatttaatttttttcctcttctcctttgaaaaatgaggcatttcaaaaccatttttcccccaatgtttttatggtaactgaagcatcattgttcattttgcaataactctagcttttgctttataggttaaattgatacagccaatttgtctataaagaaaatgtctgtgaattgagtcttctttttgaattgacccctccattacaaaatgaatgatgtattctaaagagaggaaaaaaaaaaccttctcccttttcacgtatcattcttcttttctgagtgtagagagttgttggagtaaaagcattaaagtgatcccagtgttaatatgtggatcctccaagctgaacattttaagtttgaaatttacaattgttataacaattgtcccctgcctaatccattaggtgacagcattagctagaacccagagctaggaatgctttaacacttatgagtacatttgagttggcctcattgttacccagtcgtcaatagtgtccttaacatttccagctgcctcatcactgtttgatatgtacaaggggctgggacaagggtgtagagggttccactcaaacatgtccccagtatcaggagaaaacacacttcaggaaggcatggttctgatagtgggtcaggaaagaaaataggaaaattggttttaacaccattcagttattatacttcctgcctcaattgaaatcaaaagaaaaatccttgtgtctaaagaataattacaaattttgaaatagagtgaacgttccataaagaaaattttaaatcttttttctaagaaaatacttttcctattaccttgtgcaaatggcaatctatacttattggctgaataataattgagttaattaattaattcctggcagatttattatttcattagtcactgaccatgatctataccacgatagggtgaaatttaaaagttcttccattattccttcaaattgcattgcagagctcttcacacataattaggtcttaaattttttgcctaatgttacttattgtttcctaacaaatgcagttcaaaaactttagagtgacattcacagccctctttagtcttatcacaatcccctttccagccacaatccctactattcccctgcaaccatcacacttctgctttgttgaactgccacccaggtatctccagaactttctactgttccttcttctaatccttcatctatttttatctgctcaaattctacatctttcctgacctggatcaaatgccacgtctcaattaagtcttccccaagtcctcaccccctttcttctgaataacaagtatttccttagtatttctctggtgcttattatagcactgccacactgaattgtgtgtatgtatatacattattgatttgctctattagattataagttcctcagagtcaagagtctgtgttacccatcttgtatcttccattgcaattttatagagtcttttgcataaaagatgctcaaaaatgtttaaagaagtaaaccagctgctgagaaactgctaaatgtttgcactgagcattttggcagctgtgtcatcccacttggtgatgctgcctagcacatacacactaaaacaataggcctgaacactaaacaataggccatggtcctaaagggtattttgttctacctttcttgtattgtgagttgatctttgattccggagcaactctgcatgtacgtgtttgctgtcaaaataaatgtcttttttgtctcaccagctgagatacatttaggtgaagatggcactggtaaaggaagtgtgcaggtgaagttggtgaaaatgttctgacaatgtttatattttgcaggcttggaagtctcatgccaagtgaaccatggataagtattcaagtttgatatttgcctaatgcgtggtaaaaaaataataataataatttctgtatcaagactgatttgatggccaggctctgtggctcatgcctgtaatcccagcactttgggaggccatggcgggtggatcacctgaagtccgaagttcaagaccaacctggctaagatggtgaaaccccgtctctacttaaaatacaaaaattacctgggcgtggtggcgggtgcctgtaatcccagctactcgggagactgaggcatgagaatcgctcgaacccaggaggcggaagttgcagtgagctgagattgcgccattgtactccttgcatttcagcctgggcgacgagagtgaaactccatctcaaaaaaaaaaacaacaacaacaaaaaaaaaaaactgatttgaattttgcaaaatagtattagacataaatatgttgatcaacttttggggaacttaaaggttaactttataaatggagaggaaaaatcgtcctgcagaatccacgcctcaaattatctggctttcaaaaatctagaaaaatattttgtgttgatttgtctacattacgacatataaaagtcatccaattgcctggatgtactctatccaaagtcatggcttttagataacagttaatgggagctcgaactgcttctcacattttatttgtaatctaaatcagaaactctaggtctcaggtataatcattccttatcattaagacaaaataaaatataattaatgataaaggatctcggcagttcaacttaagaatacagaggttaatatacttaaatctagattcttctgaagttctctttgcacaaaaaggtgaatttttgatgtgacttattctctggttcttggtattcatcataactaaggaggcaagggaaccccgtgacttggttgggatgcagaagccaaaactcatccatttcaggataaagagcccaggataagggagaatcataaatgaaagacaaagccagaagaaatcccactggcttagaatgaagttgatggtgaccaggaagattaaccctttccaaaatataatatggacacgtaatactctgttgatgaacacaagagtgcctatacatcattgttttggttcattactgggagcagggtaaaaagattcctaaggtctacagtaagtgagcttagtgaaaatacaccccaaagaccagagggaaagctctggaaactgctggatcatcagatcaatagactcaaagatgactaagttgggaagctttatgcagtttaaacatttgtgcagggagtatccccacacagccttttattgacagctacagatcaatggtaatttttgatcattttcaacttacataaacctattgaccccatggccacctttggggcacttcaagtcatcaaaaataatcagaggagatggtgtaaaattgtcagactgctgaagactccaagtagttgcatatgtccccaggagctgagtcgagaggttaaaatatagttcaaattgccagcagaacctcaactgacagagtgttccagagagtcttgtctttatgtctcataaaatgaggcactgatttgtatccaaactctgaccttcatgcatataaagttaaagaaggaaaaaagaggctgaatcccattgaagatattagattgcaaagaatggattattcctagtaaaatatttcttcctgtttttctttgttgagtcatcttcttcatctgctgcctaacaaaagtagctgacatgcttgtagaattacgtacaatatggacgtggacatagaatgaacaaagacaaaacagaagcaagtgcaaggtggcaggccagaagtcagggacaacaaaaaatgtagtcaaaaaaatcattaggaagagtgaaaggaaggaaagagcaaaataatggcaataaaggggaagaagtaagagtattgaattaagataatctctatagaggaaaaggagtgagagaagaaggaaagggtgaataagaagaaagagaaaggaagaaacggaagaaaagtgaagcaaaggagtaaaaggaaggaaaatcgtctttagtgatgacttttcctagttagtaagacagaacgctacatctccaaaggaaggaactgaatccaaaacatctaagatccacagtgctcaagcaaatatcctaaatttaagaaaaataacaagaaacttagtacgtaaatgagagccaacccaattcacagagtgaactgcatccaaattttgcagcaggattctaaaatagtgaactttgatgttggaaattcattcaggagagaataatataaattatttcctaaaacgtcaaagaataaattggcaaggattatcttgtcatttttatgttttcttcattttttaatatagcttttactaaacattgacaaaaaccatggctattgtttagatctatttaaggagtctatatgtggtttgtgtgtgtgtgcgtgtgtgtgtgtgtgtgtgtgtgtgtgtgtgtgtgtgtataaaactattcaggaataacaaagtagccagatgcagcagtggcttgcacctgtaatcccagcacttttgcgcagccaaggcagaagggtgacttgagctctagagttggagaccaacctgggcaacatagtgatacccaatccctacaaaaaaaggaaagaaagaaagaaaagaaacattttgttttaattagccacacacggtggtacatgactgtagtcccggctactccagaagctgaggcaggagaatcacttgagcccaggagttcaaggctgcaccgagccatgatcatgccacactccagcctaggcaaaagagccaaaaaataagaataataataataaattaaataaataaataaataatgtaatatgagaacttgtcctcagtataatttcatgatacagaaattacttttacatcccaacatgtggttatttctctcccttttttttttagatacatgtagaccaggttaagcaaaacaactgttgtaatgaccctttgtaggagtatacccctaaaaattttctgtgccaggcatgcatgaacttcagcttgcaacctacaggccatatttctatattagatggtggaggtttggaagctagggcattttgaatacttctgctttcaaggatctgagccgtaaatgtttattaaacgaatctataatgaaatcagttttgttatttttttaatggttgcctggagtgtgttggatgactgaatgccagttgttaatcattaagtactcatgttaccaaaagtgtttgatagtattgccatctaggggctgaatggaattctcagctctgaaataaattataattgagcaggtgcagctattgacaatatacatatgtttttgctttatagcccacatgcttttcatgtttcttatgacaaaagcttatgaaaaaatgtcccccagcagcccaccttttttatatataatctgttagaggtgattactatttgctttggagcgtatgcttttttggcatctattactgaatattctgaacaaagaattattcttttttgcattattaatcttgcccatgtttgccctatttccacagaaaaggaatcatttatcagaaaagagtgtttgtaatcgggacttgtagcatcttcagatttaatattcattatggtcattctagttctgtgctatatttatctaaaaggccaatccaatgttatggagaaataagtttttaaatatttatgatctaacttttaatattttaaaaaagagaaattagtatttctgtaaaatttgtttcagagtctgattgctcagcaaatgtttaaatattaaaagatttcaagaggttagcgtgtaatatcataatgggacttattgaaataggaaaattgactttacaagtttttgatatgtgaaggaaattgtattttctctgcctatgtttaacacataacaagaaataacacagttaaaatatacagccaataatgtcagaaaacagcaccaaaacctatttctacattgttttgtttttgtctaaccagtttgtttggaaaacaattctgtttgattttgtcatcttgttttagattttatccaaaatgatatttggatgcccccacacataattttttctgatgttcttgggtgcctactttcagaaataactttcactactccactttatattcttcttcccttgttcatcaaggaaagaagacaattgaagaccatgtatcacattcaaacatctaataaaccaaagcagatcattgaatgtaaatatcctactaacccagtcaaaactttctcatgatttcttatatccaatggggatggtacgcaacagaaaatgccagtgtgtgtgtgtgtgtgtgtgtgtgttcgtgtgtgtgtgtttacctatgaacacattactaccccacttgcatacataattcctactttaaaaggacatatcctttcagtccagatgtggaaagagcaccccagggcctttagaaacattaggattcttagctccagtttagttatgccaaatatgttaatgctgctctccaagcagaaaaacaaacaaattttaaaaatcctaattaggctatccctttttttcttttcttttaaagcaacaaagaccaaattctccaagcctagctaacaattacttttggtaggtttcatagttttacttatggtgcttttaacaaatgaaaatatttttatatctatattaataatagacttctctaagggtgtttgtacatgtatagttgaattggcttgttactgttttcttgtgtttatttgttttattgaattcgtaagatatatatacatgccaagagaatgagagagggagactgggaagatggagagtcttgtgtacaaacagatttggaaattaggggtgttcaggttaactctccaaacccttaatattaacctggcaggcaattatcccagtctcagacatgcagcttggcaccactgatttccattttgagctggatgcagcactgatctgaagcatcatgttttgtttttttttttaatgtttatatatcacacgctttgggctgcaagcactgaaaagtcaaggatgctatctggtccactttctgagtgtctgaaatcatacaacattgggtaatatattcacggtgtcaacaagaataagaaaaaatgcgttgttttcttaatgataattcaaaactctgctgtagtgtttgcgctgctgttgcctacaagctttggccatgaggttcagagaatgactttccagcaatattgtcagtttcaaaaaaaaaaaacaacaacttaacctgttaattttcttacagggaacaagccatcaagcccacctgtacgggttagaaccattcacaacatatcgcattggtgttgtggctgcaaaccatgcaggagaaattttaagcccttggactctgattcaaaccttagaatcttccccaagtggactgagaaactttatagtagaacagaaagagaatggccgggcattgctactacagtggtcagaacctatgagaaccaatggtgtgattaaggtaatgtctaccctgcataagaaattatgtttggtgttctccagataaatagatgagccctgacatgccatcaggtcactgtgggaaaactcccttcacagcctgtttaattctccttgatagctcctccaggcacttaatcatagatcacagaaacctagcttagatgtgtgatgcttcctataacccaacactgagctaaatgctctccatggattatctcatttaatcctcacatcaaccctactaggtgggtaccaccaaacctcatgaggcatatgcaggctaagtaactgcccaagcctacactgtaagtaattgagttgggatttgaagccaggaactcacatcagaactgaactctaaatgactgtgttcttactgcctcctgaattaccctacccagttatttgcttaagacttgcctaatttatgcttcaaacagagctcattaagcaagccacaggtgtctgctaacttcccaacttctgtatgtagccgtgagaaacaatgttataaatgttgtatacgtatctcaagctctgccagcccatgagtacagggggactgtattttcatgaatagcctgcattttgatgttttgaaccttcagccacacaaaaaccagccttcatctacctctctgatgttcctccccaaggatggtggcagacatacctgttagttcatactactgcctttacctccagtctctcctggccgtggtccatctcttaggccctcatcaactaccttctgcgggctgggactgcagagtcccccagcctgcagctgctatagacacactacccttttctttgccactccttctccaagaggcagactcccacatcaattccacatcacagggttgagactaagctgttacttttaataaagcctccctgaaaaccctaagagagggatgacagcaggaaattacgtgcagcaataactaagaactgtaactagagctcacagtcccaggtccatcctgtgggctgcctctctgcctagcttcaaggcctgctgcaagtagcagtagcaagctgcttcccaccagcctgcctacatgtggacagaagccagacttctcccccctggggcaagaggcttgagccttaggattcatgaccttaaaatccaaatcacggccccaaggcacccatcagaaaagaaagctccttttccctcaaagcacttctccttgtgggtatttggagtcatgagagcatctgcttcttggtggcataattgacaataagaatattgactccttggacctttatttacatttcaccaaatattaagcaaatatttggtgaaatacttctactaagtgccatatacttattcaagagtgaacaagacagtcaggttccctgatgttacagaccgtgtgtgagtgcacgtgcgtgtgtgtgtgtgtgtgtgtctgtgtgaataaatgtggcagagtatatgaatggtgggggtacagaaaagcaaacaataagctagtaaataaataagcaagggaattactgagagcgatgaatgctataaagaaaattaaatagaataatgtaattatgcctgctcaggctattttagaatggaatatcatttgaatcaagttgacatttgagctgagtcctgaatgacaagacagagttagtcatgtgaggatatgggggcaaaatgttccagacaaaatgaacagcaaatgcaaggcctgaagccaggaatgaacttggtgtattcaaggaaagagaagaaagctagtgtgtatgaagtatttgggagaaagaaagatggcactagaagaggttggagggactggtaggagacagattgtcccaacattgtaggctgtggtaaagtttagaatttgttccaagtgcaatgaaaaattactgaaggctttaagcaaaggaatagcatgatcaaatttacgtttttaaaaatcactctggctaccctgtggaaaatggactatataaggaccaatggagtttgagaactattaaagatttcaaggtagaattgaaggtgggtcaaattagagtagcagttgtgaaatcatgcactataggtgaatcgaagatacattcagaagatagagatgacaaaatgtgttaatgagctgaatgagagacatgaaggaaagggagcgctttgagatgagttttgggtttaggctttgggctattgatgaggaaggggagactggaagatgaacaagttaggagcaagtagatagtgtgaggtacaagtctaaaactcctgagagtgttctttgctgggataaatgttcagaatccgttagcaggtggatgttatataaacccatggtgccagaggagatcagctatggagagaatgtaactcaacctgttgagagtctgggatcaagccctgaggcataaatgtgggggtcaagaggaggaaagagagccagcaaagactgataagagggaactaggctagaaggaaaagtgcatgagtggagtgtccaaaaagagaagagaaaatatgccaaaatgttgctgagagcagaagtaaaatgaaggcagagaagccaccccgagtatagaaatgaggaggtcactgtgatctcgacaaggagagtatgcagtagaatgggaaacctggttggcatggctggttgaggagagaatggcaagggaggaagtaggacatcaactcattaaagccatttagatgaaaagaaaagcagagaaatggagcaataggtggagactgtgggatgggaagttttatttaaaatcattgaaaaatactagagtacatttaaacacgaatagaaataaccagtagagggagataaactggtgacgtaggagataatgagaataacggcagtagtgaagtcttggggaaggaggaagggatgggatacagcgcttaggtggccttcagtaggtacagagatatttcattcatagcaaaaggaggaaaagcaaatcatgtaagtctagattcacatggatacagaggtcagaatatataacatggaggcattcttctctaactgcttctattttcagtgaacgatgtggttatgtcaacaatcaatcaacggtgagggagggaagagggtgttagtggttaggggaaaggaagaaatatgaaataatcacctgggaaaatgacagagcaaaagcatgagggaataaaataggattacaaattggtaatcgcctatttaaaatgtatggatagaagtttaaagtgagaccaataaaaatgtttgggtgtttttctacaaacccatttcagagcttgagtatagagggacagctaaattttacactaattagagatttgccgggtgaatatcaggggcagcaaggggtgcttggggggtcacagaggctgcaagctagttatggaacctatgctcccttcagaagatatggcagtccccttcccacatgggggtggtcttgccctgggtcctcaacaagaaaatcacaccaacatacaacattccaacataaagaggtttccaaacttctaggctgtgtaatcttagggaaaaaatggagtatgttaacaatttagtctaaattaagcttgcccaagaaccacttctgggaatgtttcaagggtgtgccttccaagggctgtaaaatgtgtcctgtcccctcttgagagtcaccatgatagggagtcatcgaaaggagtgtgtcatctctctcaggtttgttggagcaggaaaaggttggaaaatcactgttcaaaaacacctgcattcagattaacttacttcccatctttcaaaaaaaatgaaaacttgctctacatttgtacagtataataagcattcagatgtttttttccagaacaaaagactactttgcccccaaaggagcaatcagttcttccatggcctggaagagaaaacagggtgtttttttccatcccctagtcataaagatttatatacatgtatatatgtacatgtatatatatgtatggatatttgtacttatgtataaaatataggtgtctgtgtgcctaaacacacacacacacaagcatactctttcagccctggcactctgtaacaacaaatgattaagcgttgtaattccatttcccagcaaatgccgtggaaggtagaccctactttagtcagtatgagatcagaagcagttcatatccataaaacaggagactttaatactattctctactttaaaaaaatacaaataggagaaaccttgtgaataccatttaagtcaaagaatctgattcaatagcccttagttttgagataaatgtttatgtagttcccaaactgaaaaaaaagaaaagaaaaaggcaaagaaaaacattgtttgtctctctgtgggccttatgttaactgaaaaaaatcacatatccccaattaatatcagaatacttcttctaaattagggtcatcaaaataaggaacaagggggtgaaggttaaaaaggggctaagtaactacacaaagaaattgtatgctgcaagttatcccttttgcttctgtccttctgtagacatacaacatcttcagtgacgggttcctggagtactctggtttgaatcgtcagtttctcttccgccgcctggatcctttcactctctacacactgaccctggaggcctgcaccagagcaggttgtgcacactcggcgcctcagcctctgtggacagatgaagcccctccagactctcagctggctcctactgtccactctgtgaagtccaccagtgttgagctgagctggtctgagcctgttaacccaaatggaaaaataattcgctatgaagtgattcgcagatgcttcgagggaaaagcttggggaaatcagacaatccaggccgacgagaaaattgttttcacagaatataacactgaaaggaatacatttatgtataatgacacaggtttgcaaccatggacgcagtgtgaatataaaatctacacttggaattcagctgggcatacctgtagctcttggaatgtggtgaggacattgcaagcacctccagaaggtctctctccacctgtgatatcctatgtttctatgaatccccaaaaactgctgatttcctggatcccaccagaacagtctaatggtattatccagtcctataggcttcaaaggaatgaaatgctctatccttttagctttgatcctgtgactttcaattacactgatgaagagcttcttcctttttccacctatagctatgcactccaagcctgcacgagtggaggatgctccaccagcaaacccaccagcatcacaactctggaggctgctccatcagaagtcagccctccagatctttgggccgtcagtgccactcaaatgaatgtatgttggtcaccgcccacagtgcaaaatggaaagattactaaatatttagttagatatgataataaagagtcccttgctggccagggcctgtgcctgctggtttcccacctgcagccttactctcagtataacttctcccttgtagcctgcacgaatggaggttgcacagctagtgtgtcaaaatctgcctggacaatggaggccctgccagagaacatggactctccaacattgcaagtcacaggctcagaatcaatagaaatcacctggaaacctccaagaaacccaaatggccagatcagaagttatgaacttaggagggatggaaccattgtatatacaggcttggaaacacgctatcgtgattttactctcaccccaggtgtggagtatagctacacagtaactgccagcaacagccaagggggtattttgagtcctcttgtcaaagatcgaaccagcccctcagcaccctcagggatggaacctccaaaattgcaggccaggggtcctcaggagatcttagtgaactgggaccctccagtgagaacaaatggtgatatcatcaattataccctcttcatccgtgaactatttgaaagagaaactaaaatcatacacataaacacaactcataattcttttggtatgcagtcatatatagtaaaccagctgaagccatttcacaggtaggtagccatgtctcggttttctgagagtaagccactgctgacctttctattgcctgagcccttggtcagttctaatgaagactctaaaaatgggatgcaaggtgtccccaacctccatccacctaaacgtgcatagtagacaaagcacatcctcacccaagcaaagcctgcttgcataacctccagagagcagaattctttcaggtgatgttttgagagtcagtgtttcagaaaggtttgcaatgcatcctggtatctgaaataagtaggacagagatgaggctagtccccctggaaatacgcaggcccctggacagttctgacagccccgatagggtcatctggccagactgtgaagaaaatgatgtattattttaaggttaaaaagtgccaatcaatgagcgcaattaccagccagagttagactaaaacaaaatttgtttcgtgaagagccttcttatcaaatccagcacttcttccaggaataataaggcttctctgactctactttcttatggtttctcaggacagtgccactttgctagctcatgttttcctagcggtcccatctgggctctgtgacatgcatggaagtgcgttgttctccacacaaaagaatcttgcccattgtttaaataattgtttggcagttttccccatcacattttaagtaacttacatccccagagagaagggtaataagagacattttatgcttaaaatttagtaaaatgaacagaatcacttaaaaaaattaaaggctgaaagagtgttgatttccaactacctcaggtaaaattcagctattattgtaatctagtgatgtgtagattagatcctcctataattacctctgatatatagtgctgttgaaatgaaacattcgtggttttatgcatctactcatgacaattatttagggtctattaaatattaaacagtaattaaaacttcctcaggtatcctctgcagctaatccacatgctatgtgagttggcttttatattaccttacactgattcagggcattaaaaaggtccactgtagctgcagagctgtatattctagactggcttcctctttacctgactgtacctccaactttcaaaaaccatatcaatttgctcccttttgaaactcttattcaaaaagtattctagaggtgaaagagtttgtccaggcatgaaaggaatgctttttccaggctggaaagaaaagtttaatttatctgataaattgcaaggatatttaagaatgtgagagaaatctcttcattatccactctaactgaatctgtaagtggcattgacataaaacagagtatcacttctatatgaagttggagttcatgcgtggttttttgtttttgtttttagtggattaatgttcactgaatattgcaaatgtgtgtgtcctcctttcagcacccccagctggtcagtaagaagaaatagtctgggaaagtcctaagtagcagaaggaatccagcccaaaatttaaaaactaccacggataacccagaaaatgaataatctttatgtgggaaatcaaaattgacttcacagaattgcttagaagtcagatctaccatacacagctatggatttgatcaccaataaactggtagccctgtcatggtggagatcggcatgagaggagaaccaggggaggaggagaagaaagtgggaataaaataagtcacaaagggaaaaaggtgtaattaagaaagcaaaaaggtggaagagacagaacatgtacaagaacagaaagcagtgattcaaagagcaaagaggggaggtagaaaatagaagaggaaaaggctagaactaaaaggaataaaggtagaaagaagatagctgggtgcctgcgggaaaattgaaggtgtcataaaatcaatggtggttgggaatagagaaaaaagtgctcatttacagccataggcactaaatactcacaaaaactcattttgttggaaaggagaagtccctgctatgtaaatagaccttttcaagtagcagagaccagctatgaggcaaaacataattgattagttgaatttaactggatggtgataaggtgtcttcatgattgataatctggtgtgtagttgggttaactttggccccgcaaggtctttgtatcatgtaagggaggctgttttaagctgttaggtatcaggtgaggggatttattaccactgagaccgtaattccatgatgttccttcatgacctggaaacattcctgggggatcattccatgatgttccttcatgacctggaaacattcctgagggatcatttagctctagctgcaaaggtaggagtccaggactgctgagaactgcttcatactttctaaggtctgcattcttcattgctatgttaagtaattctgaagagtaccagaattttcatgccggaaagaatcttgagagttatttattccatacatccttgtttaggggaagaattgcactcacccctttcgaacagatcaggaactttagtttagaaagccagggggattttgattgttcaaaaatttccatggaaatataatttttttttgagacagagtcttgctctgtcacccaggcgggagtgcagtggcgcaatctcggctcactgcaagctctgcctcccaggttcaagccattctcaactttgttattcttaagaattagctgtgaataagaatacatgtaagcttgtcttttttttttaaggcctggtgttttaaagattcttcccatgaaaatctattttgctgaaaatcactaatttctgccttatgtcctgaaggtatgaaatacgaattcaagcgtgcaccaccctgggatgtgcatcaagtgactggacattcatacagacccctgagattgcacctttgatgcaaccccctccacatctggaggtacaaatggctccaggaggattccagccaactgtttctcttttgtggacaggaccgctgcagccaaatggaaaagttttgtattacgaattatacagaagacaaatagcaactcagcctagaaaatccaatccagtcctaatctataacggaagctcaacatcttttatagattccgaactattgcctttcacagagtatgagtatcaggtaagaaatgtgtattataaacaattcgagctgattgtttgcacccgtcagcacctgcctgtaaaaatggtgcacaatttgaaaaggcacttaaagaaatgtaggacttaaggagaataataatattccttaaaaatttttaagtggtaaatgaggaaaaaccatgttcattgcctttttcattttcttggtttttgagccatattatatacgttgtttttcttaagtagattccaggtgaatttgcatttcttattagtaaagtggtttctgccattaagattccctctgtcagcgttgccttggtaggagacactccttatttaaagatcactttgaaaataactcattactcgtaccaaaataaaatcaaatagcaaacatctctagcctcggtgctcaagaaagatacagaatgttgaaaaaagtctagaggaatacaactcacctgcccatggcgatgagttaagttttctctgaggatggcctaaaaaaataagactgcattcttaaaaagccaagaattaagaataatattcagaaaatatggtgaattctgtggaggacttctgttaggtttgttttgttttgccatcagagtccatttgcattcttcttgtgataacaacctcatttcctgtgggagaatgtgcttcccccaccctttgctcaggcgtggtgggagtgtcaatcaatgtgtcaggctgtcttctagccaagtggtgggcacatgagccgctcagcccctcagatttgcctggggcttgatcttcagcagagtgactcagaattttaaaaggtggaggtgagaagtcgtgataaaatatccctaacctcaatctaaaagtttttcttttccctgctatttccaagcatggttcttcaaccgttcttttaattccataaactcacagtaaattctcatttgcttaagtcagaatcagtgcctcttgcttgcagtcaaagaaagcttactgactgatgtaagcacttaagtgccaggaacaatgccaacagaaattttctaaaagaggaaactgagccttaaaaagcttattataacatgaaatactaaaaataataagtcaccaaaaagatagtgaccaaatcaatgagtacagtgaatacagggaacattttaagcatgaaaagaatattttaggacaataatgtatgggacaaattaccgaattaataagatttaaaaatataaataaattctcgaatggtttggaaaaatacacagatataaatccataatcccttgtttgcaattccaagtctaaaaatctcttaaaagtattttcttgctttaccacaagtcatttggcaacaaaacccaatctaaacagacttgagactatttacagtatttatttatcccatttaatatgaatatttatatgttttgctacaaaaatattgctttattataagatggctaatcagatcatggtatggatattacaaaatatacagtatatacattttatcctatttcaaaatctaaaaacaaaattattttaaaacacatcaggcccccaagggtttaggataagaattgtggtttatgtcataaaggaacaaaatacttaccgatgccaccatcggaaacgtaacactgttagaaacagccagaacctacgtgcctgcccttttgttcttttctcattacctttattgagaagtgtcacgttatcaagctgtcagttatctagtctcccttacaaataaaaatggtaccttcgtgagagagctggatgaaatcagcataaaatcttcagccgctaattaaacgcaacttaatgacccatatataagaaacacaaactttctctggtattgtgttgtgtcattgggttaaattctggtcacatgatctgtggaagtctcattccagtttttgtttgtttgtttgtttctttgttcgagacagagtctcgctctgtcacccaggctggagtgcagtggtgagatctcgagatctcaactcactgcaacctctgtctgccaggttcaaacgattctcctgccttagcctccagtgtagctgagattacaggcatgcaccaccacaccaggctaatgtttttttgtatttttagtagagacagggttttgccatattggccaggctgatgttgaacccctgacctcaagtgatcagcctgccttgacctcccaaaatgctgggattacaggcatgagccaccatgccaggccccatcccagttttctatggaatggaaagctccaagcatgtgccttgtctctagtcagatttttcatcaggcactaaggatgactaagaacaaagggacccacatttcagaggagaggcaagttaagaaccttaggctgtgtggtttcttttgtaactgttactatcggctctgtgttacactcctcctccatactcatctcactcaaatgaaagtatttaatttggtttttgatctccaatttttatttattagctaatcccacgtagttacaacataaggatagaaaacaaagaaaatcaaaatctagcttagcccaaaggcccagttcttatggaaaataatattttgaaaagcatagattaaatgctgaaataaatgatcagaaaatattagtttcatttagcctgtgtaaatattgagtctatgtggaccctgagtaatcttacagaagtcatttaggaagttatatactaaaacaatttatttttctttaacaaaagagcatttttgtatttgtgatgaatttgcattgctctcaaaaccacttgagggttacttcatctgcaagtggcctttgaaaataccttcattgtcctatataaatctgctcacccagcaactgacagtgatttcacccttctgcagaggagtgtgtttttgaggtaattgtagattgtagggaataaaaacaaagacctgagaaacttcctagcagtggggaaggattaatcagaagatcgtgaggatgtatagttggggaggttgccacccacatggtgtgccttgcaagtatcagctggggctccccaccaccttcctacactacattacatcattgtactcatttctggttttgagttaaatcattgaaggcagttgttaaaatttagttatgtgaaaagaacaagacagttttcactagtctaaatcaactcattccatcagttggccagtgatagaagagggtatcgcatggataagttcttttgtttttctttcttcttttttttttccttcttctttgtttttttccttcttcttctttttctgagacacagtctcgctctgtcacccaggctggagtgcaatggcacgatcttggctcactgtaacctccgcctcccgggtttaagcaattctctgcctcagcctcctggtagctgggattacaggcgcccgccaccatgcgtggcgaattttttttgtatttttagtagagacggggtttcatcatcttggccaggctagtcttgaactcctaacttcgtgatccacccacctcggcctcctaaagtgatggatgagttctaacgggcaggagggtcaggaaatatctggagaaatggatacttatagagagggaggagctactcactgcagaaaaccaaagagggaaattaaatgagcagcaaatgtcactcacctcaccacaattcatataaccagcttgataactagctcctttgaaggtgagcaaaatccatgtgatatcacaagcaccttctaagtgttcactaatacttcaatatggaatgccctaaaggtagcatccccactgtttacagtacaagtggaggacctaagagcttgttcaaagggcagactcctgggtggaatgggaagggaccccagcaaccagtattttttttctttttttgagatggcatgtcactctgtggccatgctggagtgcaatggcgcaatcttggctcactgcaacctccaactccccggttcagtcaattctcctgcctcaccctcccaagtagctgggattacaggcacacaccaccacgcccagctagttttttgtatttttagtagagatggggtttcaccatgttggccaggatggtctcaatctcctgacctcatgatccacccgcctcagcctcccaaagtgctgggattacaggcgtgagccaccgcgcctggcctagcaacctgtacttttaacaagcagcctggatagtccacaacccacttttttttggaaatactgcctcagagggtgagacattgctgctatgctacttaagccttattttcaagcggtgattttctgaatcagtggttctcagctttgtgcattagaatcacctggggaaatttcacaacattctgggtgctgatacccagtccccattcccctgtagttctgattctgggatgggttctggaatccctgcgattcaaaaggttcccaggtgattctcatgtgcagccagagttgagaatcactagcctaaactgtcataaacagcccaaataagtgaagccagctccccacaaatgcctaatttacatgatgatcattgataatagcctattgacgttggtctatcctggctttcctaaagaagggtcctattgttttgatgtgaaactagaaaggagaacagaatatattatctacaaagtccatgtctcagctactcatataatttattttaatcttcctcatggattttatttggattttgttattgttgttttattttcttttgtttcttacttgggaggtccggtctttggtggtaagagtaaagttcaccatcatttaaaacaggggatttttctagtttgagtcatttcagcatagcttccagaattctgggattctgaaggataacactctggaggattagctttaataaagccagtgagatctaaaatatgaatcaaaaaattaggaatattactttttcttgttttccacaagaatgggttggtggctttacagagtgcactgcagggtcccattagaaagcaaacattctctgtgaatttcaaatgcaacttagtttaccaaaatctaattctcaaacaaccctgtgaatgtatgttccatgcataaatgcgatgcatctgtactaaataaaattcttccattgcacagacctcttccttaaacagagatcacagtcttgcttgtgctacagaatatttacaaatccaagaagatttttttaaagacaataatcatttctatcttcaaccctttcaaaattgggctattctaatacatgcagtgtgaacctccaaattctatgtggagcagttcttaactgtttagcagcaaattaagacaatatttttcccacaggctttgagagggacctgggtgtgagtctactctgttaagacattttggtttttacctttggggagtgagctgaggctaatgaatagctctcagtaattgtgcattcatattcatactcttgcttaaggcaaagactcaccacggatttgatagggcccgccaccaccccccctttcactgattcatgctgtcagtgacttaattagttttcctgaaactatctcactttgacagatttttgcggtaagcacccacgcacactcagggtctctgaagcattctggtgcctcatgactgggtgactgagaagcagtaggtcagtcttagaggaaactctgtgactcatggcatggggtctgaacttagggctagtgctgcaggagcccatgcagaatggcagtctgctgctttctaacagaccaacactgcccccaaacaagaggatggaaagaagggctgtggaggagacacagaaggggatcctcactgttgctgccagtggcagctgcctgaagactgccagaggtactgtggaggccttccctgcaccagcccccaccataggctaccaaatcgttggcgatgagttagaagtgggagggagaaaggccaacatcttctactccttctctcactacttctggatatttgagcacattaacctctttgggcctttcctcataatataaattaggcctgctatgatggaatatcatagactgggtggctttaaataacaaatatttatttcccacaattctagaggcgggaaagtacaaggtcaaggcacctgcagattcagtgtctggtgagggccaccttctggcttacagataatggtcttctccttatatccacatataccaggtagaagaacactagtccccttcatgagggctccaccctatgcaacctaataacctcccaaaggcctccataccatcatattcaagattagccttcaacatatgtatttgaaggggacaaaaacagtcagttcatagcactcatctataaaaggaagcaccctccagctctgtattctatgggcagagtagtggtaagctacaggtatataatttttagaaagtctaatcaaactttatcttctcttgattggtttttgtaatctacagtttgtaaaaccctacaaaataaattctcacccaaagcaacagaattttctaatggtatttagctttaagttgtgttgatgcaagtgaatgtatgaaatcagcttcagataataaatggatatatggttattcatcaccaagatggacacatggaaatataattagttgtgtctctcattgaaacctaacatatttattcactaatatattttttaaagtatagctatattataacatatgaatgtaaataaataataaacttatttagttagctacaaataagtctcatttatgttcctgagaaaacccacactatcaaaaagttgtcatgactatttcactacaagtaacagaaagccaatgtaaactaagttaaacagaagggaattgtttctgctctcgcatctgggaagggcattgaaggaatcccttgaaaccaaagaaaagatatgaacaccaggtcctggaaacctgggatgcaggactcggatgatgtaggattcattcattctgtccctccttgccccatctcagcttgtctctgtttggcttcattctgcacactttcaccaggcatctgaggaaatcactcccagattcaagccctttctgtgcatcagttttcttgtctttaaaatgtgaatagatatagcattggactcataggcttgctctgaggttaaatgagttaatatgtgaatgtgcttggaacagcacctcatacatagaaaccacttcgcccatataacaataatgattattattattacccatccaccttagagtggaaagaggactataagtcaaccaatacaggactctgactgatccttttgcactacctgccttcctgtgaaccaagagaacagaggactatgattgagcaggtgtggtcgcagggcccacctcctacaggcagggctgcatgaggtatgcgggaaatgcttccagccagaagcaagaactgccctagcacgctacacacaccaaccacgggaacaagtactccacacctgtgagatattgacaatccttgtgctctttcacattggatgctcacacccttcctgttttccaaatgaagaagctgagttaagatcacatagcttgtgcaagaaagatacttaatttctgataacttcacctttctcatttaaaaaaatgggtgtgttatgagaactaagaaatctgtgtgtctagtaggatgcctgctacttagtaggtccatgcccccatccgatccccccaggatctcactagttaaaagaaggagaaactttcattcaagactgtaaaaaagccaggttaagacatttcttttgtctatatcaacaagtcattgataaaatgttagagtgtaaaaatctcaatcaggagtacagttgcctctaaaggtgtgatactccttccgctaggaagttcaaccctcctcatccttgccatttctcttctcagaaaaagagtaatttacccacatacccatgactaaaattccaaactctgatagtctgactctacttttatgcaattagctacttgctttgtattgcctgttttctattgctgtcacccttaccccatctcttttctatatcacatttagagaaaacatattgaacacattttctgtttagttttggacttgcatttaattaggtattaatctcactaatgtatttccgaccagcatggaggtttttgtctggttaatttctcccacaagaactaagctccccacacccaccccaactcccacagctcaaggttttaaatgatttattgatattgtctgactcaggcagtgtatttattctaaaactttagggcctgagtgcacaggttagactgaaggccactgggacatttccatgtatagaaaactaaagttcgccactaggcccagggcctgatcattttttgcatcgagccttttgttcccacgggagatcatttccacctgtcagtgtgagcacattcaggagcatgctctaattctttttgttcttgttccatctctcatggcaacccttaggactttattctgaagcttctgttgttggcaatcttcatggcgcctttgggacaagttatccatgtgaagatgggttggttctcaccctcttgcagatgcaactcagatttatatttcacttaaggtgatgttgatcttcctgtctctgtgttggaagtttgtttgctgaaaataaaatgttaaacacaacagatgctcttcaactgaatgtagataatatgccattccagcctgccctcatggctcttcagatggccatgaaaacaaaggctcccaaagtcacctaaaacttaggtcctgtaaaaacatctaggaaagggtaagatgtgttttacttattttcctccatcctgtaaattgagtatttaataaactgtccttattaagcacctacaatgttcaaagtgtatacctagttactaggattgaggcaggaggctaaaatccatgcactctccccttcagggacttaaattatagttgataagtcaaataaagatgcccatgaataatgtatccataaaaatatggctaggaacgttgatgtttgcaggatctgagtgatggcaaaacagacccagggaggaagaagcagcttctttatcttcagggacagcacgatttccacaccaaactctaaaggccactcttattctactctctggccagatggttttgtgcaggacaggtggcaccttgatattaaagaggtacttgactaaaatcattccacagagacatgaaggggcaccatttctctgttccttcagtcttacaaaaagaaatccctttctaaatctccatccttatgtttagaagcctctcttagcccacctactgttattggtacccatgtaatggttcaaaatattctccactgtatcaatcgggatctcagcaggaaacatatggcacattcaaagggtatttgaagaaaatttaatgaagaggctatttatggaggtgtgggtagaattaagagaatcaataagggatgttgaagtacccagggagtaggaagagccagaagctgttaccttctaggcctgcagggacaatggaagaaagtgggtcattgagaggaaattcagccttgtcaacatgcagtgccaaagagaggagcaggagaaacaaagaacctgaactctctcttccctttgatcaaaacctaatggaaaggagccagaggagaaaagattccaggtgaggcagtctgatgaagtcagcattccagagtacagaccaagccagagaagggcagaggatggatctggggaaaaaccagctcgtcccccacactcagattgatgctgcttctcaaccagtatataataatgccttcaccagtagaatcctttctgggctagaggatcacctggccagctttggcttgtcaatctatgattattgataaaccactaagtaaatctgaagacttaaggaggattgtacttaagtacttgaaccaacagcttattacctttaaattgtaaataaacatctcaggatatatgaagcaatctaatctgcaggtggaaacaaaaatgttaacacattcaaataagtcagatgccttaaatggtaatttgtaagaacatagttgagacttcttcttgttaattgatttatctgttgatggagctgatcattactaatatgcctataagcatctagaaaactgtacggttctctctttgattcctataggcatatttctaatggaaaccagtaataaaattcttttctctaaagaatccattgaattgctctaattttttcttttgttcatgtttgaggactttttgagaaattttaactaattataaaacaaagtagagaagccatccaattaacaaatttcattgtagagcaatatttttgaaaagccaggcttttatttactctaaccctcaaagctctacagtacagaagtacctggaagaaagatacacagggaggtgtgggctaaattccaaatgctgtggggagttttccaatcttattaatgtgtaacaactaactggaatccaggagtgagttgcacaattgctatctagccccactagatcccccaaactgttaagtcattctctcctgtcttttcacacaaataatgtgatagtaatcactattatttatttagggtttgctgtgtgctaagggctgtgttaagaactgcatgtatattaactaatttaatctcaaacaaccatttgaaataggtgttattactgacactattttacaggtgagaaacatgaagcattgaaaaattagataccatgcccaaggatatagagttgataagttgaaggactcaaattcgaaccttaagattcagtttcaaagactggtttcttaaattctaccccaacagttacctccaaattgcatttgtatgcagctttgggactttcaaaaatcaatgaaatatttataaatgtattcatcccctaccccattcctcagaaatttctagaaacaatattgcatgtaaatcttaaaatagtcctgtgggatagatgttgttatttcttagcatagtcaagaacctgaatgatttagcaagttacctagtcaaaaagcaacagagtcagaactcaagtcctgactttctgaccccaagttcaaggtggctctgctgaactgcagcttcttcaagtcacctctatcaggagcacaaattcctgaccctgtgaagacagaccgattagggttgcagtctaggctacatgaattaccaattctggatcctcagctattaatttaaactcactaaacctcagttttcttatctgtaaaattgagattaaaaaaacaaacaacaacaaaaaaaacttaccccaggaaagttgctgtgaactttaaataagttgactttaaggctagggtattgtcacttacaaaaaaaagtaaaatttaatatataaatacatagaaggtgttcagtatccagcattcctgcaaaatgaaaatcaaataaagtcactctcctactgcaaaccctacttcccccattccataagatgcaaactcctctctagttccatgaggactttcgtggtctcatttttgtccaattctgtcctcatcccattgctttccggcccttactcactaaggtcagccacactggccttcttgaggatctagccttaaggcctttgcacatgcttttcttttccatagaatgctcttccctcagatcttcatctggtactttctgccaattgtttcccagcttgatggtcatctgttgagagaacctcctggataagccaaccattttctgctctatcaccttatgtatatcaccctacaatctcatcatttcctttctagcatatatcctaacctgtttattttatttgtgtttttattgattgcctctcctcaccaggatgttaatgccagccttgttcactgttgtatccccagctcatagaacagcatctggcatatagaaatggctcagtcaatatgtgttgaattcatggatgataaatggtcttacctaatttactatccttcacggagatgttaatcacaattggtgattgtgatcttagcttcttctagcaacttattgtggataaagtatatattttaatgctatatccattagggtatagttattattgcagagaacataatggaatttcaatgcatttacacatgtttgaacaggatgaaatatatgagtagtacttgcttctgtgtaatatgcaatattgctgaaagcatgataagtggcacgagagatggatgtcacgttgtttgtgatagtttcccctgtctcacttttaggctaccctccacagaaaaagccagtccacgcagggctctatgaaaagcccaggacagcaacccacccatgtggaaggtgtgtacaggccttcttttaatggccttatgtaggaagatgtaaagagtttgggcttttatgtcacatatctgtattggaaagccagccttaccacttaccaagttgcataaatttctgtgttcctcagttttctcatgtgtaaagtggggataataataccaaccatataggattgtcgagaggaaaaatgcaaaattagtacatagaatacacttacaaaagtgtaagtgctcaataaaccccaaaactacttttacatatcctccatgagagtcggatgggggtgggttcctgtttcctcttagggagagcagatataagaaaaaaaaaaaagtatgtgataactccaaattttgattatttagttttattgttaaaagtgaatcagggttgggaggccaaggcgggcggatcacgaggtcaggagatcgagaccatcctggctaagatggtgaaacaccgtctctactaaaaatacaaaaaaattagccgggcggggtggcgtgcgcctgtagtcccaggctactcgggaggctgaggcaggagaatagtgtgaacctgggaggcggagcttgcagtcagccgagatcacgccactgcactccagcctgggcaacagagagagagagactctgtctcaaaaaaaaaaaaaaaaaaaatcagggcaaatttcagtatttcacagtgttaggtcagtttttccttcttcaggtattagaggagaaccatattcacaagtattaaatggctccaaagagcaaggcggtatgagaagcagtagcgacaagacacccaattctagcatgggaaatgtcttgttatttttccagtagcttcacgtctctgaacttcaaaagtgctcatggaaagcaagacaatgtcctgctgtaccctcttcccctgggtcccagaattcaattaaaatcacgttctatcttgcctaatccaaagtgttttagatgaagggaacctggaaaacgggactatatctgtaaaagtgtgactgtattgtatccagcaaggttctatgcagatagagatgctggaaaacatccatttgatggtgaaagaaaatcagatagatagacagttaaataaatagctcctagagcttttcagcacattattccttcataactggagcctgcagggctactcatgaaataaaacaatcttgtaatcatgtaatttcaaattcattgcattgtcttttttgccaacattctttaaccgcgattccagcaaagaagatttcagcatattgctattcaaacatattcaaaacctatgacaagctaccctttaagaaggcattagcgtgagtgccatgggaaaatgtactccaaggttgtagatgaattgatatgatctccttgattgtatctttttatttatgaggcataatttctgagcactggaaagcaaactgcaatgagtgatgactaacaacaaccaaagtcataaatcagcagcagtgaaagaagtagtgattttgatcgaatctattgaattagctgttggccttagccaatacaggtattggaaagacctttttaatatctatttgtccccctcatgggaatgtgataacaatctcattacatgcccctaggaaacaaataatttaattgtttgcccgttaacatacaacctgtttacttattaattactggcatagctgttcatgctagattttttgtttatttctgatgtgaattgttacaaaattatgttcacattccttagtttttataaacaattatgtctccttagagcttcttgatataaatttgtcctcagaattgttgaaatgctttttttaatcaaatattgtcattatcccacaaggaagtatgttacagagtttcacagaagttgcagagagctcagatattcttccctctcttaatctctgacagttaacacttttactaatacaactcttgtaataagcagcctggataaagaacaaaaatctcaaattgctccaagcgtaaagacagtcatcatcacttacattaggagttaacagattagagatcttttgtaaaagattaatcggctgaatttggttactcctgtattacaattttatgaggagaataatagcaaatgtaagaccaaatagacatcagcttggtgctgacccatatacaaaccatccataaaccatatattatgaagtatgttcccttgatttgaacaagacttgtagcattgccttggccaaaagaatcataaaatattttcacaatttaggggtttttcttatgataccataaaggaaaaatgcatcaggaacccccttgaaatgtacattaataacttagctttgctgtaagacaatacttggaaaacatcagtcctaaggaaggttatttcagaaagatatgagacattgagcgaggcaaagcattaaggtgaaaactactttgtttagccaatacaggcattagaaagacctttttaatatctatttgtcccccttatgggaatgtgataacaatcttaacaagttaagtgtggaaattgtgctaaaaaataactagcacaggccgggcgcggtggcttacgcctataatcccagcactttgtgaggcggaggtgggcagatcactaggtcaggagtttgagaccagcctggacaacatggtgaaaccccatctctactaaactacaaaaaattagccaggtgtggtggcaggcacctgtagtcccagctactcaggaggctaaggcaggggaatcacttgaacccaggaggtggagatcgcagtgagtcgagatcgcgccactccattccagcgttggtgaaagagcgagactctgtctcaaagaaaaaaaaaaaaaaaaaaaaaaaagaataactagcacagtaacagaagcatccaaagggtcaccattcttggagatttctgatacatttccccttctcccatcctgtgcagactgatggtcccttctctttcccattcacaaaaattattacaatgcttctgttcacaaatgtttgcttttctcctagaataaaattaggaggagaaatgttgggttgagagaaattgggagcatttagaataatgttactctgcactgagagaaaaatagactcagcaatttctagaaatatcaaggtttcaagaaattactccttaagtgaaaattaggaggcaagaagtggttctacaaagtcagtaaactctagttctgtttggaactgtgaaaaaacacagtaattaactctatgatgattattgaattgtgacatattccaagatacatttattgtgtttatttgaatgactaaagttaatgtgaagtataactctaaagagacataacaaatagaaattgaaaatgtacagtgcctatattctgtacctggctctataaagaataggcctttgtatttttcaaataatattgggtgtaaaaagcgcttggaaatatgttgaaagggcagagtccaaggtcttctcaccagaaattctgatacaggtacccaaaatcattttgatgaccatggctaaggaatatattgtgacaaagacttctcttaaaagaagatttctaagaggcaattttcaagagagaacaaatgattaaattcattgttttcacagcaatgtgattatggcagcttagtggcagatgttgacactccatgtaattaaaaatttttaaggcaaaatacaataattagtcctttggggtaggaaagagtaaataaaagaacaatttcatttttttaatgaacaacaagcataaatatggtaatagtctctagttagatttaaaaatatattacattgaaaacagaaattccattgaaaactgacatattaatctatcattttgctagttaattacagaatttgtggctaaacaattttagtttttatgcttattaaaagtagttaatctatgttttctatgacattttacattgtaactttcttcatggttacaacagaaaccttagagaaataaatcaacaagtcagtcagtcctaacttttcattattaacgactagggaagtttctgactctacaatcataactgtgtgtgcacccactcattcacatgtgaaagtgttcaccaaacccaaataataatgtatttcagcagcaactttaatcatctttaatcttttattataaaagaataaatatgttcagtctatgagaacacatggacacagggaggggaacatcagacacagggaggggaacatcacacaccagggcctgtaagagggtggaggctgggggagggatagcattaggagacatacctaatgtaaatgatgagttcatgggtgcagcaaaccaacatggcacatgtatacctatgtaacaaacctgcacgttgttcacgtgtacactagaacttaaagtacaataataaaaaaatatatatatgttcagtctaaacactgtaggaacaaaaatatcctgaataaatcaaagatgaagaacatcttggcttttttttctcttggccatagaatttataagccttacttgcttttcttccccaataataactcttccatttttctaggagaagcccacacactaaagaaagagaaaatacacaactgtttgttcacaagatattttatttattgatttttatatgggttcattgcaactaaaagatcgggacatattgctaaaaagttttctatgtgggatctctgctgcttctttctctaccctataaagacagaatcgaatcttggggcattgtttctcagtgggaatcataagcataacctgttagtatttttaccctgaaccctgaactacacttcaatacttttatctcttgcttagccgggcatagacaaaaatccacagtgatattttagacaaagaacgtttttacctcagcagagacagagacaaagacagagagacagaaggagacagaaaaaatattattcacaggttcttttttccttttctcctagtggtttgatataacagagacactgcctcatcatacaagttttgtgaaattcataatgcttcattatctcagtcagctttctcttcattctgttttcattttcacagtagctcatgtaaataggttgatcctgctttgcataagcatgttgatttatatgaatgctattttgatctcaaattgattgaatactaaaaagaaagtctaggaaaaagagtaatgtattatgaaggactcctgccaaagacaaaatagcctgcatacattccctattagtgatggggaattttgaattgcctggttttcaaagagaatatttccaaggaaatatagcaaaacactataatactgaggcccaagtgtttttaaaatccagggattaaatcacattttggaactagaactccacctagtagaagttcacgtaacacaggaaggctgagatttagtacaatctacgacactaccattaaaaagccttaatagtatttatgattctatatctacattgaaaatgaaagaaaagttaatgttcataagccagagccagaactgtgctgagcacttgctatgaattatgcttatttcatctcattttctttcaacaccctatgcctgcactacttccatctcctattggtgcacagtaattaattggcaagttgttgaatttttcttttattatacctagttgcactttcttcctcattttcctccccatccattgtagcctgaatttaaattctgcctgcgctcaaatcaccaaccaaagttctgctcttggcaaaaaacgtcatatcaatatttgcaccttactttgcattcctttgtcaagaatattgttttaaatcttgtcattcattgtgtaataataggtgtcccccccaccacttcccagaaagatatttgcagtaaaagaggttgttctggggcacagtgaggagacaggaaccctcctcatcagccctgaagtctgacttcttcatgaataacctccacctcccctccctagtgtaagtctgacctcacctatttctgaggggactctgagagcagctgcagttgtattctgatggatggactctaacttccatgaaatctggctctcccattgctagctccttacttccctgtgcttaccaaaacaaacctccctcacctaagacaacttgtacatgtctatccatccttgcaagctaagacaccttaacctaatctagaattgcaggtattcgtctatggacaagtcgtttaattttcatgattctgactattttatttatgcatatggatggcatacagaatcaaaaaccctgctcattgaaacaggcactggagagcagaattcttgtttcagcacttgtaacttttgtcaccttgaacaagatagtgaaattttctgaggctcaatttcctcacctttaaaaggggactagtaatacattctcggctcaccttacaaggtttccattggaaggactaaataagctgacataagttaaagtgctttgtgaaatgtagagtttatacaaatgtgagtgattattatgcaaatgatgagaggatgtatccgagctctaaaaagagcaggtgtatctatgtaagtaggttagttgtctcttttaaaaaatgaggctcctggcaatcctatcagcaaggggctggagatttgcatttgacagcaacctgaaaacaattcaacatcagaaaatttactttcacaaaggaatccggaaaaaaagaaaagtatgaaaaccactgataggagttgacctaactactaaaaatctgtctaatgtttcttctcttgaagatattattgatgcaaaagcaaagtaaacaaaaatgaaactaaactctcactgcaaaatattctcataggttttttctttttttcccccacaaatatctcctattttgaacattctgcatgctttttttttttttcaatactgcatgcctggaatgtgtgtactgtagaatcaaacaagtttttcagatttgtctttaaaagctcgggggcaaatttttagaaaatatataatgtagaagaaacacaatgagaaaaaaatttcctgaagttaggctttcacatgaaagcttactaaggaatactactactcctaaacacgcagacagtcttcttgtattgccatttagatctatcattctgattgatcactgtgtagttggctattattgggcctaatttaaccctatacactcacacatccatctactctgtctattgtacctgacattctacaaattacttactcatgcaaatgacgacctaaggcaaccttttaggatattcgtgtttaattatacaaatggttcttgataaataagattatacatcgttccatatgtttattccctccttgatgaaaggaaatttaattttcatgcagatttggtggggacaatgtttaagaattgctgagttttttgtagtctgcagatccatccagtctgcagaagctgacaaaatcactccacttcccacacagagatgagcagttttttcattaggcttaaatcaacgtgctgcattctgaaatcctaaacggccccctttgtgttcacatggtcaaaggcaaaaggcaaaaaataaaaataaaaaaggaacagcctgctctccttgctctcctgtgtgattacaaggttgcaagatcaaagtttatctcttcctgttgtgtttagttgcttttggttgccaatttcgttttttttcctttcttttttttttttttttcccagccttagggtatcttgcttttgacagtcttgttgatttctctttggaggtctgggcagtgaattctgcaggaaaagcccccagtagctggacatggtgcagaaccgggccagccccaccagaaggtctcagagcccccacgttccatgtgatctcttctacccaagcagtggtcaacatcagtgcccctgggaagcccaacgggatcgtcagtctctacaggctgttctccagcagcgcccatggggctgagacagtggtgagcagcagagctaaaaatccaggactggttgacttttaaaaatcattactatgaaacctttgtttttatgtttttgtttttccctccatctttcttatccttctgttctcagttgctctacggtgaacttagtagcacaaatatccctcagagaagaaaaagtgaaccctgaggaaacatacagaaagtatgtaaactcttagggagagggatgctaaaggtggtattaaagactccacaaacgtaagaaactaagactttaaaggcaatcacactaatttaatttaatttaatttaattagaaaacagatcaaccacttagagtggtggcacatagtaagaagttggcaaatggtaattattggtggtgtaaatgttagtatgaaaacaaaatagagcaaagaatatccttggaatctctattttgacatgcacaaatctctaataatacatggaaaactctcattcctctggtgatttcaagaaagttctaaccctttagaagagagagcagagcagctccatcagcatagccctagctccactgtttgttcgttaacacgtttgaggcacactgggagacaggagagattgctcagggaaatcatctttcacattgtgcgttagccaagccacttcccggaagcgatgctaagaatcaactagaccagttcctgcattatttaaatgaagataccagcagccagcacgatgaagactcttgtctctgtggtatagcttgtgtcactctcaagtttctcatgaataagtggagattataatactttgttcacacaaacattgtatagagattgtgcagatcctggtattacactatgcattatttaggccaatttagggaacaatttgggcaagtgtggagaattcctctgagaccagagtgtcaggtattgaaacacaatttcaacagataacttacatacagggaggcttggattgaatgttaaaggaatattagcatattttctatagggcttcgtactcaataaatatagatgatgtaaatacaatcaacccttgattatccatgcttataaaatgataataaactaaaataatttatatttggagggcattgtatgcattttttaacagctcttcttaatcatatgttctttatgtcaacatgaacattaatttcagtttctgaactcttgttccgaagagtacttattaaaaccacaatgaggttaaaaatttgctcaaaataaaccaaaactttataatcctacaaagatgattgagagaagactatgatattttgtaaaaaccaacaccctcagaggaagagatagactttcaagccctccaatacttatacctgattttaatgtagatctgaaaagattttttgactgagaaattgcatgcaagtaaccatggcagaatatggaccttggtgaatgctgactagacatataattggaaggcagattttgttttttgaaaagacatcactctgagggtcatagactttgatcaacactttgtgtgttccgtgccattttctaatacctttctaaggtaatagataatcgataatattatgccttgtgatttccatcctgctacctcaaacgtctatttaacggttacattatcagatttttcacctatttgtcatacctctctaactgagttggtaattttttgaggataaatgtcatgctaaatgccatgttgtgtctcccagagtgcctggcatggtactccatttgtaggaggtgggatcttggataacattcatcaaacacctttaatgtttgacactgcctttatctagccttccttccttccacagctatccgaaggcatggccacccagcagactctccatggccttcaagccttcactaactactctattggagtagaggcctgcacctgcttcaactgttgcagcaaaggaccgacagctgaactgagaacccatcctgccccaccctcaggactgtcctctccacaaatcgggacgctggcctcaaggacggcctccttccggtggagtccccccatgttccccaatggtgtcattcacaggtaatgggtcaggcagaaggatgaagaaactaacaaggcatgtgtacagacatatgaactcatggtatagcctactctgcacctaggctacaaacctgtatagctacctggcactccccagggaggacttgcttattgaacagatatctatagcaaagtagacaaacaaattgatttgagtggtaatgttacctgcgatgtatttaaatcataaaagcaactaatgatagaaaggagaacaacgaaatgttttacattaaaaagacaatgcaatgtgttcgtattcaatatgctcttcctaatggttatctggaagcattccttctaccagccttcactggaacataagatacctccacagttaaatcagaattgccctgatctaatttaaaatattgtcataaaccactgtttgaaaggaaaaagaagacacttgactcaaaatcatttagaaaaaaaattatttactctaaaaagagaagaaccatttatgtctctcctcttaaaagagggaaatgtcttatctctaccaaaaaggatcactagttgctgggtaaacagcaatgtgtgtgtagatggtgacttctcttatcatttctctggttacatctgctgctcgtttccaatagcattacataaggtgtttctgagagcagtttcctgcaaatggaaattttaaagagcctgtagctctgtgaaaacaaaatgtctcctcacaaaatagaactggttttaaaagagagagttaaactaattccattacccgtcttgactctacgtatccattctcattttagctatgaactccaattccacgtggcttgccctcctgactcagccctcccctgtactcccagccaaatagaaacaaagtacacggggctggggcagaaagccagccttgggggtctccagccctacaccacatacaagctgagagtggtggcacacaacgaggtgggcagtacggcttccgagtggatcagtttcaccacccaaaaagaatgtgagtataagtggctgctaccataagccagagagattggaatgtggtcaggagaagcttgccctgaaactcggagaagccacttttaaaaacagattgagtgggctcaataacactgaatgttactgaagcattgatgaggatgactactgaggaaaaatgcctactggatttaataatatggaagtcaagggaaaatttaagaaggattttcttgtggggatagggtaaaaataaatttaggggaagttaaacgatcaatgggaagaaagaaaatgaacaaacactggtagaccatttttataagaagttttgctactccttttctttgtaaattacatggcataatctctagtatgtccagagagcattgagacatagcactattaggaaaagcaaaagggcaagtgagtgaaggaaagagcaatcaactaattaattgggggcttccttacatttttatataatacagtcacgcatcgcttaacgatggaaatatgttctgagaaatgcatcgttaggcgagtgtcgtgaaaatatcatagaatgtacttgcacagacctacatgttataacctactctgccccataggcatgtgactgtgctgaatactgcaggcaattgtaacacaatggttatttgtgtatctaaacatagaaaaggcacagaaaaaatctgatataaaagataagagggccaggcacagtggctcacgcctgtaatcccagcactttgggaggccaaggcgggtgaatcacctcaggtcaggagttcgagaccagcctgaccaacatggtgaaaccccatctctactaaaaatacaaaaattagccaggcatggtgacacatacctgtaatcccagctactcaggaggcttaagcaggagaatcactttaacccaggaggcagaggttgtagtgagccgagatcacgccactgtactccagcctgggcaacagagcaagactccttctcaaaaaaaaacaaaaaatgtaagagatggtacagggcagctccattataatcttatggaaccaccatcatttctgcagtcttgctcaaaatgtcattatgagatatatgactataacttagattttataaggtatatgctttcattgtttaataatggcaaacacaaaaagtattaagaataataagtgcttatcagaaccaactgcataatttatggagtccagtggaaaatgaaaatatggaatcctttgctgaaaaatctttaagaattccaagacagtaacagtacagcatcaggctaagtccaagactcttctatgtcacaggcccttgcaacagcacaggtcacatgccaaggaagctggtccagcttattataccccaacccagaggcaaccactactaatattttggcataatcaattcttttaatctcctttctatgggtaatttttactatatggctgaaatactataactaaaatttcatagtcagctttttatacttgacgttattgtatttgcatttcccgtggcattaaaaaaactctttagccaccaattttaatggctatacaatattccatatataaattaattgggacattttgttttttttttaatttcccattaataaatatgatgaaaaaatctttgtgaacagatctttgaatgtctggttatcttcttaaattaaattttgacaaatagaatttgctattaatacatcaagtattttaatattttaaggctttggatactagtttcatgtttgctttcaagaaagattatgtcagattataaatcttacctaaaatactctatctggcattgaatatgatgccaattttaaaagcaagaattacgcattcataaagaccaatgtctcacacaaggagcttaatgtgtctgagcaacaacatggtaggatgttagtaacagatcacatttacagaggacttgtttgttcctggcagtattttagcattttacaaataattcttacaacagacctattattatccaaatttacagatgaaaaaactgaggcagaactataaactgtgtactgcgattccaggatgccattcatatagactatgatctgaactgaggctcttggagttagacagtgacgtggccctaaactaaggccagagcttaagtaacctggccagtttccacatctagtaagtgcagtaattactctgaactcatggtcactgagctcagctgctgtctcagtactactctttccctgatcaattcatttcctactctctgtaatcaagacttcaaaccatctccaccttcgccaaacctccctctgccgctcaccctttctcccttcatgcccacaacccagctcacccatttctccctttattctctgcagaactccttgtcttgtaattttccaggaaaagagatgtcttcagtcagtaatttgctccacttcccactgcagacaaagctacctgcatataccccattgctgtcagtgacaaggaaagggtggtccttcttccgtctgaaataaacctgccttccatgcagtgaacttcatccacttcattactcaccatcccttctctctccttaatctttctgtgtatctcactttgattcaaagttccttctacccttctaatgttaaagcaaacaagctcctcttcccctgcagtgatgtggactctactctctctgacagcaaaactttcctgaggaacggtctgcagatgctttgcccatatcctctcttccacttactctttaacttcctcagcactggatgaaaatccctttctaagtttgcctttggcctccatactgatatatccagaaggcatgtttctccaggagtcaccttcactgactttccagtagcattcaacgcaactgaactttcaatgttcaatccttttttaaaaagtggtttaccctcattttcattaccaccctctcctggtttctcctctacttctttggattttcatttttagtcaactttgttggttgatcttcttccgctgcccaaatcttaatcctaaacattttaactttgtccccttgccgtttctctactccctcctttcctcctccctcatcaggtgagttcatctgctccaaggctttggttccaaaagccaaactccagtggtcacctcctagtcaagtgctctgttttgaagtgtatacccctccacccagattcctcacagacatctccctctgaatttctcataaccagcttacattggacaggccccagacagagcttgcaactttccccttcaagctatgcttcctttagtcctcactttctccattttcatctccagcactgggcacagtatcttagattccaatcaatgttgtttaatgaataagcgagtgcacctaacactgcatgtttattgttgacactgctcaatcagcattttttgtcacccatactatattcaaagcaaactgtaatgattcttaatgtgtgctgtctgattttgtaatctcctttgcactacatccagaagccaattttgctaaatgttgcagttttttggttgatgtggccagaaagccagagaacagctaggtgagctttgtaatttataaccaattcccttttgagtcatgaagcttagcttttgccagaattttttttttcttatgcttggaagaacaaagtgaactgatttaagattttcttcctgtggccaggcacactggctcacacttgtaatcccagcgctttgggaagccaatgggggaggattgcttgaggctaagagttcacgaccagcctgggcaacatatcaagacacctatctctacaaaaattttttttttaaatagccaggtatggtgacatgcgcctgtagtcccagctactcagaagactgaggcaggaggattgcttgagtcctggaagtcaaggctgcagtgagctgtgatcatgtcactgcactccaaccttggcaacagagcaagacttggtctttaagaaaaaaaaaaaaaggattttatctatttgtgtttttttatattggagaagcagcttaaacctggactagcaccataggagaagaggttcccttaatccactactgggtcaatagttacggaaaaatacaagaaatgactatgatacaggttctaaaataccacttatgctacttttaactcattataaatactgggagcacgaaaacatgcaccagagaatacaaaccagaaaataatttggggcctggtgtggtgtctcacgcctgtaatctcagcactttgggaggcagaggtgggcagatcacttgacgtcaggagtttgagacgagcctggccagcatggtgaaaccccatctctactaaaaatccaaaaaaattagctgagtgtggtggcacacacctgtaatctcagctacttgggaggccgagtagtgagaatcacttgaacctgggaggcggaggttgcagtgagccgagatagcgccactgcactctagcctgggcaacagagcaagagtccaactcaaaatagtaaccataataatttaaaaatagaatatgcagttttatatagatgtgatcacatgtacactcagcaacgggtctggagaagaagcctaacaacacatttagttccctctgcttgaatcccccttcagtggagagagaggtgaggtgtaaatgtttaacagctggcctgcttgagggaaaaatggcctgatttgaagtgcttatcagtttccatggtgtgaatacccccattactgctctcaagtgaccaacatgacagcactgaacagagttaggaagggatgggttgtagcgtatcattatataatatttccaccagccagatagagtggatgtaaatgacctcgagcacacagacggtagtaaaatgtagtgaaacaaataaaaagttatgaatttggagtatttataagctttgttttaatataatttatttaagtttatataatttaatttttagtagtggccggatttaacaatgactcacaaaattcctgaatatttaacagttggggtgagccaacttcagcacaccactggagagcacccatagggtgaattggtaaattctgttcttttcaacaaatgtgtaccgatgataacaaagtagcatgggccttatttaagcaagcctaggttcagctccttggtctcctaccagccactgacatagagcaagatatttgacctctctgaacctgagttttctcaccccaaaaattaggaatcaatctttacaggattattttgaggattaaatgagataaagtatgtcaaaagctaggagcgtagtggtacttacagctttttcagtcttccttggggaggatttgtaaactcattattctcgattattttaattgcttactctttttcctcaggaaggtctccaaaccctacaggacaaataagactcctatctttctattttcttgctagttacaagctgtttctttatctgtgctgttatgatatagggaaaaagtgaaaatctactgaactaaggtgatggagagaagtcatagacaaataacaatagagtattccttgtgatatcaggcagaatcaatgttggaaaagcattgagatttaaagagggcttgataactcttgttttggtgtttgcagaaaatttttcttatggctttatgaaaatatcttattttgaaagataacaatcaactgtgtctttacggttgaatattacaattacaaaagcataattattccttattttgttatatttcctaacatcagaaatagatggattgatttttaaagaaaaagaatcagattcaatttagtctcactactcactcctttcttttcttaaaagccaatttggtatataggtgaatcttaatgtttttacaaatatattgattattttgtagaaaataagatctcatgaaataaatctcttctgacttgacaagatgacatggtatcccttcatttgtttccacaaaaattattcatttaaaaggtgagccccagttaaggattttctttttgttttagtaaggaactgaaaaatcaagagaatgtgcctgtgaaatgcacacaaagttgcttctatatgtgatataatacttaggacacctgagcttgattatatactaatgtactatgctattgattgattagtcagggccatgaattattatacttgaattactgtttgcaaggctttttaactatcttagaaaacaaactaacagtttgagaaaaagctttaacaataaatgggtgccaaaaggacgtaattcaccatctaagcagtttggtttggagaaaaaaatatattaacttcatctagtccttggggctttgtggcaataaatattgatttgatatgaaaaatagctatctactgtacttaatagtattaaggatactttacctgttaaaaagagggaaaatgcaacaaaatatgagctccagggttatgctggtgagcagatccattgtatgttaatagttttatttataaaacaccactctctatcgattttttttaaagcaggcataaagttgctgagaaagcatttcacacatgttcccattggttttcttttcacccctgatactggttgtttcgtaatactgaggaaaaagtgaaggattctagcaatgttggttttcttttttttttttttttttgtttggattggttcggtttgattttgctcatattttttttttttaaagtgcacacctgcactccttcaaagaggttaccctttttagaacatacaactttctccccacagtgcctcagtaccgagccccattttcggtggacagcaatttgtctgtggtgtgtgtgaactggagtgacaccttcctcctgaacggccaactgaaggagtacgtgttaaccgacggagggcgacgcgtgtacagcggcttggacaccaccctctacataccgagaacggcggacaaaagttagtttctgactcctgtttctcagtgtggaaggcgctctgttccccagctttacgggatgctaaatctgaaagctgaccagcagatgctcaccattaaaatgtcttggtttaagtgcccccttcttgtgaaaaagttactgctcaggataaataaggttttctttccttcccatttgcagcttgacagcactgcagttataatgcagttcaaggggacagcgctgcctccacaggactggagggtccccaggaagggataagacccaagggccagttgggttcacaaaagaaatagcacccatacatagtcaatgactaccctaaaataatacacttctagcaacttcatagattttcttgctgtatctccagtctccaaacagagccctatcaggaaataactatctccaactcatgaggacctgaataaggggtttccttaaccttccttgatatcagcccctgaaagaacaatcttgaccctctaaaatggagttccttcttcctgtttacttacatgtcccttttctccttgccttgtttttaaattgaaatgagaaaatgctttacaaggtgctaagtattttatagtgatcagcatgctcacaggaccaatgttcactatataatgaattgattaatgagtattttattttggctgtaaggtagaggtaaacagtgagctccagcattgcatgtatagtaatagaaacttaataacatttttacaaagattcagctacacatgttcattgttacagttcatggtcacctgggcagctctttgggaaaggaaggtggcctgatggttgggagacacaggttctacctggccaggcctataaccatctgtgtgaccttgcaagggtcacttccctcaggttcctggccattggaagagcaatttagaccatgtgatttctaggatcccttttgagctctcctgttcagtaagaaactctaggtcatttagtggaaagtacacctgtaaattttaaaggaaggatttaaaccgtgtgcagaacaagatgcgctttgtgtattaccctttactcgtctgatgttcttttcctttgctgtataagctctaattttccttagctctattacttatggataggctattattacactaatgatagctttttttcttaaacattttaaaattagaagtaattttgaatattatataaaacgtcataacttgctttggaatcctatttttcatgctatgatgcattgctcttttaaaagcatgtgccctatttgtaggtgttgaatgaacaagtcatttaccagttcttccttttgtctagccttctttttccaggtcatctgcacgactgacgaaggaagtgttaagacgccgttgatccaatatgatacctctactggacttggtaaacaactcatattatacttggcgtagcacctattcatcttcctcaagaaacacacatatgtttgtttatacatacttggagtcctaatatattagcatagactatacagaagaaattgtgccaagtgttgtcagagtttttttttttgttttttttttgttgttgtttttttttgagacggagtcttgctctgtcactcaggctggagtgcagtggtgcaatcttggctcactgaaacctccacctcctgggttcaagcgattctcctgcctcagcctcccgagtagctgggattacaggcacgggccaccacacctggctaactttttgtatttttagtagagacatggtttcaccttgttagccaggctggtctggatctcctgacctcgtgatctgcctgccttggcctcccaaagtgctaggattacaggcatgagccactgtgcccagccagaaattttttaaaaagtcctcatggaacttatatcaggcaaggagttacaatacactctttttttttttttttttttgagacagagtcttactctgttgcccaggctggagtgcagtggtgcaatctcagctcactgcagcctctagctccaggttcaagcgattctcctgcctcagcctcctgagtagctgggactacaagtgtatgtcaccacgcctggctgattcttgtatttacagtagagatggggtttcactttgttggccagggaggtctcgaactcctgaccacaggtgatccacccaccttggcctcccaaagtgttggaattacaggcgtgagccactgcacctggccagaatgtactcttaaaatgccaaatattgaattgtaaatatggaaaagaccagagagctcaaactaaatttttctcctaaccacaaaccctgtcaataaagaattgtatgacttcgcgtgcataaaggtgatttacagaggaagttagaggagagatcagaagaagaaagaaaatattcagccaattcatgttgatcataatgttaatattctagattcaaagcctagaatgataaatttggaaagtgtcttttattctccataaaagattatgattgactgttgatatcgggtaatttagctcaacgggtacaattttaatttttaaggagcatcttttaaactgagttttactcatagtctctgaatctaaatttgtgatactttataaaagcaaattagagaaatgccaaatcttttccactaaaacagattcgggattgatatcctattttaaattccagtaattaatgatatatcaaatttgcatgtatagagtttttttttgaaaaataaacatgtccaaaatttctgaaacacaatttaaaaaaaaaattttttttaatttttttgagacagagtctcatacatgatgaaacatgtatattattgtcaaggatagtttcaatttgtaaaaataacgtattattctatgtttccaaactttacatgtctggatgtcatataaaatttcctacaacacttaattcttctcatacggcttatttcatttaatagcagtggtaggatagaacagatctcatttagtattctgttagcaactccaatatttccccaagtggacaagtggaggtataagggacacaggaatttatccaggaatgctctgctagcttgttactgggatgagaacaccaacacagattttctattgacttctggcctgggactttttctttgcaatggtttgccaagttaagtacgcataggaatcacctcatgtgcttgtttattgtagtttcccgggcctctggcagagattcagactcaaggaggctcagaatctgctctttaaataagtcctgtccagtgattctgacacagggctcagaaccacgtgttgagtgatgccggaaaaccaaggttgctcgccttctaagccctgccagtctagtttccttggtgaatgggaagtgtgttgttcctggaggcaggccatcaacagagacggatttactctgacactggctgtggtttcggttttctttggatctgaggcccagccaccagagtttcaaaccctgacagtgaacctcccatgtgatgcacaggtagagtcccttaaggtgaaggggtacttcaaaaagacagaagggaagggataaagggacaccatcctgatctcgaggtcttcataaaaaggagaaatcccccgttggctcatgaatacgaattgaggtttccactgtgtctggaggccgggctttgggtagagcagaggggaagaactctgaggattgtgcaatgctctggcagattccaagatgtgctgcccaactaatatccatcgtcagttctaattttcatgatgtaacttttttaaaaacattcctgttcccttgcctgaaggcagcctccaagcaggagagtggcagagacctcattttcctctgactgttctaagggctatttcccttttgaggcttccctcgggcaggctgccctcccttcccctgcgtgctgtggagcaaggggcccactgggcccatcagatcagtttctggagttacagccaacaagttgttttctctctgtgccacacacagaggaaacaactcttttagtgtgcaacctaggctggtttgtttttaatcaaacaacacacattggttcctaattaggggaatttcgacctgctggagcttgattggagtgttgactcaaccctttattttagagatgagaagcaaaggtcagagtccaacatttaatcacagagctgatcggcagcagagttagggttggcaaagtaatatccctcctcttacggagttcaaagtttagttttagtcaccatctgttcctgcctttaatagtttcaccccagttctgaacttttttcctttaagtctttccctgctagtgtgagtgtgaagtaccacgcaggcccatggagttctagaggtgttgaaaagggggagatttgtccagtgagtgagtgggctttgcagttgtgtctgcttgttcttctgacctggctgtgggtattagatttagatgagcagctctctggctcacatctccacaccagcctgtgtggccgctgcatcagatccacaggtttctgtgctggccccagcagtggctggatgggagcagatctctggccaccccacccccacccctgccgcacccctgcttagcttgccaagctgacaacataatttcactgccttcgcctatcctgcatgattcttgtcagcctctctcctatcttccccacaagacttaataaacctgcctggctgggtgcggcggctcatgcctgtaatcccagcatgttggaaggccgaggcaggcggatcatgaggtcgtgagattgagaccatcctggccaacatggtgaaaccccatctctactaaaaatacaaaaattagccaggcatagtggcgcacacctgtaatcccagctacttgggaggctgaggcaggagaatcacttgaacccaagaggcagaggttgcagtgagcggagatcacaccactgcactccaacctgggtgacagagcaagactccatctcaaaaaataaataaataaataaataaataaataaataaataaaaataatcctacccacccttcatccctgtaaagctctaagcataggacctggcaccaggtacattcttgttaaatgtgagctacttttattaatactaacttcatgtgcagagactcacaccaactgaactctcaatgtgtgaacgccaagcaaaggtaagtggctccagtgctaaaagatttctttccataggaagctttcccagtgcatttgggtgatggtttgctgagctttgctctttaacagagaggccatgtaaagacaacatggtagcaaacacaggctgttaatatcataatggaaaatggaatctgatgcttcaaaatccagtttgcacgaagtatcaggaattggactgttgcatgaagcaagtacacctcagatctccaaggagtgattttgtttgtgactctgcagcaataatagtaagggtcccagtccctcatgagaatccaagcaaggactttgctcccaagacacacagctatgaaacaggtgaccctcaaggttactttggtaacctcttttaaaaattgctccccacactcccatctttcccagggatttgtcaagacagtggtgatttccaacctgagcagcagcgccagaagtgtcagcaaggcctctcaagggctgtaagcatctcgttataacccagcaacctgctgaaccattaccccaggctgcacacaagtgcaaacaagcagtaagagacaaactgctttctgctttcaactcctctctaatttactatcaaatagcagggccagagatgacaaaaatgctttctgaaataacatttcccctttctttctctgggttttgcaggcttggtcctaacaactcctgggaaaaagaagggatcgcggagcaaaagcacagagttctacagcgagctgtggttcatagtgttaatggcgatgctgggcttgatcttgttggccatttttctgtccctgatactacaaagaaaaatccacaaagagccatatatcagagaaagacctcccttggtacctcttcagaagaggatgtctccattgaatgtttacccaccgggggaaaaccatatggtatgtttgtagaggtgtggccccatttccctatcactggactagaatacttgttttccttctgagaaaaatgtgtcatagccatggtaacaaggaattagatgtaagttatgtttcactaagtgtggggaccaagagaggctaaccctagaacagctttctcaactttggctgcacattagaatcacctggaaagctttaaaaaatatcactgcctggacttcatccgagaaattctcatatccttggtcttgagtagggcctgaagattggtattcttttcttcactccaaaactgattttaatgtgtaactagggatgagtatctctgccctgtaattgtaagccagggcctggtggagaagagttgtatgttgagattacctggggaaattataggttgtattactgtgtaatttggtggcggggaatgaacattaaaaggcggagatggggaggaaggggctacagtgctagtggtgctcggtctgtcctctggtcctgacaccctgtgccacagaggatggatggctcctcttagctatagaccactcactcccaaaataggaggtccagtaaaggtctagtgggagagggccccatcacttggtattacaggacagtcattgcccagagcactcattgaagggtaaaaggtgatttaattccatggtgcagtctggtgtggggctatgtctacctggaggaggaaaggctgcgttttctaatcctcatcaggtacccatctgttcaccaaagctgggcgcccacagggctacgtctccctgaggaggtgccttttttccagtttgcactaaggttctatattagctagtggctaccctaggcagtactaaaattaagcacagaagcctggtcaagctgcttacacttcaacatttaaaaaaacagcagtgagtgaacacagcagcaccatctgccttccagatctcttcacttttccagcactcagcaatgaatgaccactggttaagccccaacatagctggatcagacctaagtagcaggagtgttgggagcacaaaagggcagtgggccctccgaggtccacggtttgtggtttttgtgggaagtagcaatgggacaatgacgtggtggtggagaagcaaagaaggcactgcccaacaccatcagggccttggctctctactcacatctgtcccactcctctactcactcatcctcctcggagcctccttcctccctgagcccatcagacaagctctaaccacagggccattactgctgctgctccttgggtggctcacactcttgcttcattcacatctctgcacaaatgtcacctcccattctatgtaaaatttcctagccccttaacccacttcttttcttttctatagcatttaccacataacactaagtcagatatgtttgtctgactcctgaaatagaaggtaagctcccaggatcaatgatcttgtgggcctcttcctgttgtatgtgccccgggacccagaacggtgcctggcatatcataggcactccacgaatgtttgttgaatgaatgaatgtcgagtgatcacttcgaaccatgggctgtttgctcctgttcagtgaatagtcattaggagattctcactgaagagcagatatttcaaaatttttccttgttaaagaataactttctttaaggagcccatgttcctagaaggtgcactgctgctggaggaaggcagtggaagagagaaaagaaggcaggagagatctgtttagcctgggagatgagctaaactgaaactagggtctatggagtgcatggagtggtgaaagggaggttcccaagcactgctaggcacatctactgtataatgtgaggtgcggttacaggaaagtgtacccacataccagcaatgtccagaagtcatttcagtgatactttctcctgtcctttgacccagtccctataggcaggcacctctgtgtcagaatcctccatgaggaagaacactgtcttccttacttggttaacttagtgaccagaagacactcccatcattcttgtggagatgttatgttactctggatataaccccattgctcagggttttaatgagtcttgttaagcttcgttttgtcaaagtgaggaccatgaactatctgcatcagcatcacataggaggagcaggacctgaagttctgagggagaaactcaataatctgccattttaaccagaacctcaagaagtctgggccaggctcggtggctcacacctgtaatcccagcactttgggaggttgaggcaggagaatggtgtgaacccaggaggcagagcttgcagtgaaccgagatcacgccactgtactccagcctggacaacagagcgagactccgtcacaaaacaaaacaaaacaaaacaaaacaaaaaaagaagtctgatgcacagcaagatttgagaacagctgaaaatgaaataataatataatacaaaacctgtatgcagtgtactgtttgataaccagtagaaacaggtggtgggagggtgctggttagaccttgctgtcctgacaccacacaggctaagccgcctctggggacagacttaggcttcagctgagaaaagcggacaaaagaatgtaaacaccctgttcctgcacaccctttaccatcggggaaatgcacagtggcacccaactgattctttcactgagtggccaagactgagtcaggtgtgaggatgggaaggcatagagggactggctggctgccaggggctctgggcccagggaactggctcatcctcagcagggaagccattcattgcaggcaggtctcagcagaagtgaaatctgggatacaccagggcaccgggtggaattcccctgagcctgttgaatcataatttaatcctatccagttgacagtgtatttgcaagtcttcttctgttgctttttacaaatatttttaaaccaaactgctctcacaaagttggagaccatgagagacattgtcaaaaattagccaaactaaagagagtacaatttgtattagtagagcaaaatgaagtccctgttggtgactgtgggctcctcatctactcaggtgggaaagaatccagtcaaggggaagaatctgaataggaacaagccagattcacctgctcagttttccagattgactgtcttttcacttgagtaggtcaatgagctatgcccctgcaacacccacccacacacacacacacacacacttctccccctcatgtgacaagctctggtttcagtgctgctgtgaccctcttccaagcacccgtcttgtgaacaggtaagataccctttgaacatcagacccaaactggcaaaaggattttaggctatactctgaatggagagaaataggcagaggtgccaaggaatgagagtgtcttttgtatttcatcaacatttttcaagaccatacagtatacagtatagctaagtttaagttttgcttgttatttaattactggtttgaagatcctttcattccctgcaatactaaacaaatactggcagtggtacttaccttagacactaatcaattaatttccactcaccaaggtttttttttttttaatttgtttgtttttgagacagagtcttctgtcatccagactggagtgcagtggcatgatctcgactcactgcaacctccagctcctgggttcaagcgattctcctgcctcagcctcctgagtaactgggactacaggcgcccgccaccatgcctggctaatttttgtatttttagtagagacggggtttcaccatgttggccaggttggtctcgaactcctgacctcaaatgatccacccgtcttggcctcccaaattgctgggattacaggcatgagccaccgcacccggcctcactatgaagttttagttgcaaaacccaactttctctctctcatatatatatatatatatatatatatatatatatatatatatatacacacacacatacacatacatatatattcacatatatatgtatatatacacacacacatatatatacacacacatatatacatatgcaggtatgtatcctaggatatatatgtacatcagagcagtattaaatatgggtatgataatgctgtcattggagaaatgcaaggaatgtgtttaaaactgttccaaacatggactgatgctgccatttgttctcagtttgactctgtggctgatatatctgatgtgtcaagcaatgtcaccctaaaaagttacaccatgcactttgaggtacctctgtgtgctgcatgaatgcatgatcttttgcatggtgtgttgactgcacagtgaaaagcaggaacagatcattgatgacttccatatatccattccttggaaagctgaacaacatgagtgaaaactctactgaaaaaagaaaagaaatgggaggccgaggcgggcggatcacaaggtcaggagatcgagaccatcctggctaacacggtgaaaccccgtctctactaaaaataccaaaaattagccgggcatggtggcgggcgcctgtagtcccagctactcgggaggctgaggcaggagaatggcgtgaacccgggaggcggagcttgcagtgagccgagattgcaccactgcactccagcctgggcgaaagagcaaaactctgtctcaaaaaaaaaaaaaaaaaaaagaaaagaaaagaaaaagcagaaacatttcattgattggaccagctaaatcagagccctcagatatttagagcaactatagtttatcttacggcgcgttctaggtctaaattatgtagtgactttttctctctgatgttaatatcagacctgatgtaatttggaggctggaatcctataagaaatggaggaatatggaatgagaaatgagggagggaggagtcaatttccctacacaaatccaggacttttaaagtgaaagacaaacggagctcacatagtggaccaccatgaaataatattgttatctttggctgttctgggggaggagtgttctcaagagggaggctctgtgctgacatgtatgaagaagataccttgttcacccatcatccgtctgccttgccccaccactttgcaatgcagcaagcccttgccccacagggaacaacagccagagcaccagtgcatgagctctctaggtgccgaaaacactggccacctaacttgagtattagctcatcatctcatccttcttaccaagaaacccagggtcaccgtgttgtgggtgctcatagctgctaaattctgtaggtgacagttgttcccttcattgacaatgtgacaattgtcaggagacagtcattcccttcactgacaatgtgtgagacacaattctctgtcatatttcaagcccatattctttatatgtgaaatactcacagcaacttccttctcaggggttagccgataccaaaattccccggtctgggacacctgtgagtatccgcagcaaccggagtgcatgtgtcctgcgcatcccgagtcaaaaccaaaccagcctaacctactcccagggttctcttcaccgcagcgtcagccagctcatggacattcaagacaagaaagtcttgatggacaactcactgtgggaagccatcatgggccacaacagtggactggtgagttggtttcctcatacagggcctttgctaaatatcccagaaaaaatattggtacagagctgcctgtacttcaccgaatgctgccccatggcactcgcctctgagcacttagccagtgaggtagtaacaaccggtttactaatgttacttcagttgtttgataagcagggtagaaactttgtcttgttcttctggtatgcaatagatgcttaaaaataaatgcttattggctagccgtggtggctcatgcctgtaatcccagcacttggggaggccgaggtgggcggatcacctgaggacaggagtttgagaccagcctggccaacatggtgaaaccctgtctgtactaaaaatacaaaaattagccaggtgtggtggtgggcacctgtaatcccagctactaggggggctgaggcaggagaattgcttgaacccaggaggtggaggttgcagtgagccgagaccgcgccactgcactccagcctgggtgacagagactccatctcaaaataaataaataaataagcagcaaacaggttatacttcatatacttggagcagatgacaggaaacattggaatgggcctaaaacaaggcataaaatacaagcacttgttttactaaaacaaaaaggtactttttttgttttgccttttcctattggtgtatgggtagacgcaaaaagaatattttgtatcaacaggtgaacatggttgctttccaaaaccttaggaaatgatgacaaatgagggtgttactatttataagcttcatctttcataatttcagtccagtgggtacaaatcattggctctttgaaaggtaacctcttcgtgatataacatttattatcagtctctgagcggctacaataacaaaaatcctagaatttttgccaactatcaaatttcattgtgctaacttcctagatgcccgctgcagtacctaccattccactgggcctgttagaaaataaacagataggccaggcacagtggcttacgcctgtaatcccagcattttgggaggccgaggtgggcggatcacgaggtccagagttagatagagaccagcctgaccaacatggtgaaacctcgtctctaccaaaaatacaaaaattagctgggcgcggtggtgcgcacctgtaatcccagctactcaggaggctgaggcaggagaattgcttgaacctgggaggtggaagttgcagtgagctgagatggccccactgcactccagcctgggtgacagagcaagactctgaaaaaagaaaaaaaggaaaaaaggaaggaaggaaggaaggaaagaaggaaggaaggaaggaaagaaggaaggaaggaaggaaggaaggaaggaaggaaggaaggaaggaaggaaggaaggaaggaaggaaggaaggaaggaaggaaggaaggaaggaaggaaagaaggaagggagggagggagggagagaaagaaaagaaaagaaacataaccagctaggaagttagctcctgtgtttactcctctggggtaaaattattcacctccacttctttcaatcatctgcttctgtttttggatttgctctcatctttctcctccaagttctcacttttccttcactgaaaagttgatgacttccatgaagcctttcttgactaatagcaaataataaagggagttcgctggacccaggttccctaacactatataaaaaaatgtaccatccttctggcctgttcagaatgattgtataatatatacatatatataatatgcattttaaaatcacaggctgtttgatgttgttgtaacctcaactacatgagtccatttcagatctaaagtttttaaaaggcagggataattatatttggttgaaacaatgaattgctaactgatcatttttgacatgcaaaacagcaattgctatacattcaacataatacattgaaagttcagatgaattattacatctaatcttcacaaactgtaggaagtaggttctattatcatcctcattttttacaaaaagaactgaggtttagagagatgagtgatttaatgagagattacacagctagcaattatttttatgggtttgggttcttaaaaacatcatctgactacagagctcctatttgtaactattatactgtattgtcatttttgcttgctttttacggtactaataatgggcaatgtgcaaagggactcaataacaagcttttgaaggtgccagtacttggcaagttatctgtttattataacattataaccaacattactaaccctatttgataaatacaaaatacagcacaagagtgggaagaaatggagcacaaatagctagcattctgcctcttccatttaccgtttgaactaaatccatatatatgtgtgtatatatatgtatatatacagatcaccagaggtcaggagttcaagaccagactggccaacatggtgaaaccccatctctactaaaaatactatatacatacatacatacatacatatatatatatagtgtatatatacactaaaatatatagtatatatatgtagtgtctatatagtgtgtatatatatactaaaaatatatatatatacccccagctaatttatttttatcaagtatatatgtacacacacacacatcccactctacagatgagtagactgaggcttctgaggcttaggttaaaatatgacacaatataaccctcaaatcacatatacattttgaattagtctatagttcatgtgtgcatgtgatgtgatcctttcaataagagaaatttaaggcaaggtctgttttagaccccaccatggtgttgagaataaaaaagcctttaatacttattactttttacacttaattgatataactataaattgatagcaaatactattgatagcaagtatgtagccaatgatgattggcttatttttcagtatgtggatgaagaggacctgatgaacgccatcaaggatttcagctcagtgactaaggaacgcaccacattcacagacacccacctgtaaaggatggaaacccagaagacgtaaccctggaatgcaaggtctgcacccatttcctcctgggttatcactcacacatcataaatgctgaaaagccattgtttattatcctataattctttaaagaaatgatgactgtttttgaaagtgttccttcctaatagaggtctaagaaatgatatttttctcatcttaaatgagagagaatattcatatgaaaatacttgatttgctcttattttgtagaagacaaagaagtatgtaattgtcacttggttctgtttggcagtgatgctcctggttaactgaataatcagtggcaatttcaagatggctcacagttgttagaagtagtaagttagttactggctcaaaaatgattctgttgaaaggatgtcactgctgttcatttctatctgccatttctgtcagggttgacacaatcctgcaagaatagttattctaatgatcacagctgctaaatgaatcccaaactttgcaccaggtcgacaaacttttctgaaggttctatttatttaccatacatagggttacttaccaaactttttgacaaggctgaaggttctatttatttacaatacatagggttactcaccaaactttttgacaaggcaacacataacttacacataaatgtctctgttcttgcatttatgaattttccaaaaatctaaggagtaaacagcttatttatacattttgaggagaaaacaaagtgtttcactaggaacacctctacttgaaccaatgtttttatttcatatattttatagttttgaaactagtttctcataaaattctgtcaattcactgaatatcagagaatactgacatcttcaacctagcacatttcaaatggaaactactgttctatttgcaatattaggctgcgtgaaattttaaaaggaaaaatgtatctgttccttctagcattaacatatatacatgtagagacaagactatacctatgtgtatatatatgtatatcatgtatatattactctgcactatatcccttctttttggagaactagccattattttagccacagaatcagtaagaacagatgatatgcaacagtaccaattacggttcaaaaatgtctgtcacctgctctagttggattacaaagtcattggtgaaagtcctatggcaagaaaaattttcttgcaaatcatccacataaaatcagatatttaaatttgttcttcatggaaaacagagtaagaaaacctcttgtcttccttcatccttaaaggtctttgtgaccccaggaaaatattgactctgtctaacacacaatagtcacaatactttttgtgaatctacaaccagagacaggcaaaaacttgtaaagtaagggatagtcttacttattctgcctgaaaacaatgtattaccccagggcccaacagtaaaagattgtggactttttgggtattgagatttcatctagctctgtgagagagcagctcctcagactgaccaactcctagacaaagtttgccaaccataagtgtcaaaagcacaggccagtattaagcagaagttctaccaccttattagaactgctataaacaaaagcatctgaaataattgtgcacatctggcagtgactgtagaaaatacgaaatatatatttctcgccaagtttttatactttctgaaatgaaaacataggattgactagtttactggtttttattcccatatgccgattctgggacaataaagttgtttaaagctggcacaaataagcattaaccaaggctgtgtccaccttctgtgagctacttaaggtatataggaaaggagtggtcacaaacttgcatcctaatccttggtggactcttctaagaatacagtttgctagtcacaaagaatagtctacaaatatgctttgctaggttcagaagattgagtttatcctgatttttgaaaaattaaccaggtatctttatcactgtgtatttttccaagcacagtataaaattttaacaacgcacaaaaaaatacagaactgcaggggattttatcttggatcattatccatttaatcatctaattagacatgaactcagttagctgaatcatttacattttgactccatagcttagggcagacagaagcctgtatggcttctgcccagaactctgtcccctgctacatgtctaagtttacttgtatttatttcagagaagaactctaagatgttgctttgctactttaagtggtattgcgtgccaagcctctattatacaaaccatgcagactcgcctctagagattctgattcggttgatctggggtgtgtggctgaggcatcagtactttttaaagcttccaggtgttctaatgttgagacccactgatgttccacaatctggaagaaatcatgtacaggaataatatgctatgcacagggactatgctccttggctcaccccttctcccttataaacaatgagcagttcttgatgaacctctttaaatttaaatctcctgactcacattttaccaattgtacatgccacattctcagcttacgaactaccatgttttgttattcttaatatcaactgtttggtaagagtacagttgtttttatacactctaagaaatgtgtttataatctactgtaatttccactaaatggaacccaaatattaatgttatggtaccatatactgatgtaaaaatcatgctggcatccatgaacacaccggtaaataaaacatagtccaagtggaagaattcattaataaggaacttttaattatgtcacaaatgaatagttggtttccaatgcacaaatatcatgtaaactaatctaaagatggtttgcttaataaatatttgaatgtgacc

SEQ ID NO: 5267 - RNA, 110 nt, Artificial Sequence
  chemically synthesized
  misc_feature (1)..(30): n is a, c, g, u, or other and this region may encompass 17-30 nucleotides
nnnnnnnnnnnnnnnnnnnnnnnnnnnnnnguuuuagagcuagaaauagcaaguuaaaauaaggcuaguccguuaucaacuugaaaaaguggcaccgagucggugcuuuu

SEQ ID NO: 5268 - RNA, 106 nt, Artificial Sequence
  chemically synthesized
  misc_feature (1)..(30): n is a, c, g, u, or other and this region may encompass 17-30 nucleotides
nnnnnnnnnnnnnnnnnnnnnnnnnnnnnnguuuuagagcuagaaauagcaaguuaaaauaaggcuaguccguuaucaacuugaaaaaguggcaccgagucggugc

SEQ ID NO: 5269 - RNA, 114 nt, Artificial Sequence
  chemically synthesized
  misc_feature (1)..(30): n is a, c, g, u, or other and this region may encompass 17-30 nucleotides
  modified_base (107)..(114): This region may encompass 1-8 uracil;
nnnnnnnnnnnnnnnnnnnnnnnnnnnnnnguuuuagagcuagaaauagcaaguuaaaauaaggcuaguccguuaucaacuugaaaaaguggcaccgagucggugcuuuuuuuu

SEQ ID NO: 5270 - DNA, 23 bp, Artificial Sequence
  Description of Artificial Sequence:  Synthetic Oligonucleotide
  misc_feature (1)..(21): n is a, c, g, t, unknown, or other
nnnnnnnnnnnnnnnnnnnnnrg

SEQ ID NO: 5271 - protein, 9 aa, Unknown
  Description of Unknown: Homing endonuclease sequence
LAGLIDADG

SEQ ID NO: 5272 - RNA, 20 nt, Artificial Sequence
  Chemically Synthesized
uccaguuggugacaaauacg

SEQ ID NO: 5273 - RNA, 20 nt, Artificial Sequence
  Chemically Synthesized
cacccacggagagcgcugua

SEQ ID NO: 5274 - RNA, 20 nt, Artificial Sequence
  Chemically Synthesized
augaguaauaacuauaauug

SEQ ID NO: 5275 - RNA, 20 nt, Artificial Sequence
  Chemically Synthesized
auuuuaagaauucagcugag

SEQ ID NO: 5276 - RNA, 20 nt, Artificial Sequence
  Chemically Synthesized
aguuuguucucugugauugg

SEQ ID NO: 5277 - RNA, 20 nt, Artificial Sequence
  Chemically Synthesized
ucaacuggccugcaacugca

SEQ ID NO: 5278 - RNA, 20 nt, Artificial Sequence
  Chemically Synthesized
ccuuucaaccaugcaguugc

SEQ ID NO: 5279 - RNA, 20 nt, Artificial Sequence
  Chemically Synthesized
gcauaugaugauaguauuau

SEQ ID NO: 5280 - RNA, 20 nt, Artificial Sequence
  Chemically Synthesized
agucugugaucuggacagaa

SEQ ID NO: 5281 - RNA, 20 nt, Artificial Sequence
  Chemically Synthesized
aacggaaaguaguuucauuu

SEQ ID NO: 5282 - RNA, 20 nt, Artificial Sequence
  Chemically Synthesized
cccccaaauccccugagauu

SEQ ID NO: 5283 - RNA, 20 nt, Artificial Sequence
  Chemically Synthesized
ucaaugcggcugucacugga

SEQ ID NO: 5284 - RNA, 20 nt, Artificial Sequence
  Chemically Synthesized
augaaaugacaugaaaaaga

SEQ ID NO: 5285 - RNA, 20 nt, Artificial Sequence
  Chemically Synthesized
caaccuuacagcgcucuccg

SEQ ID NO: 5286 - RNA, 20 nt, Artificial Sequence
  Chemically Synthesized
uccuguucccagcuccaaga

SEQ ID NO: 5287 - RNA, 20 nt, Artificial Sequence
  Chemically Synthesized
aaugcaaccacugcuuugca

SEQ ID NO: 5288 - RNA, 20 nt, Artificial Sequence
  Chemically Synthesized
aggcacacagcucagcuggc

SEQ ID NO: 5289 - RNA, 20 nt, Artificial Sequence
  Chemically Synthesized
ggggagacugggaguaugac

SEQ ID NO: 5290 - RNA, 20 nt, Artificial Sequence
  Chemically Synthesized
uuuaacacuucccuagccaa

SEQ ID NO: 5291 - RNA, 20 nt, Artificial Sequence
  Chemically Synthesized
ucgcugcucuuguugcagaa

SEQ ID NO: 5292 - RNA, 20 nt, Artificial Sequence
  Chemically Synthesized
gaaaaggcuguguauugugg

SEQ ID NO: 5293 - RNA, 20 nt, Artificial Sequence
  Chemically Synthesized
aagaaaaggcuguguauugu

SEQ ID NO: 5294 - RNA, 20 nt, Artificial Sequence
  Chemically Synthesized
uuaauuagcuccuuuggcua

SEQ ID NO: 5295 - RNA, 20 nt, Artificial Sequence
  Chemically Synthesized
aauguaugcuggcuuuuaag

SEQ ID NO: 5296 - RNA, 20 nt, Artificial Sequence
  Chemically Synthesized
uaacuugugugauucuggag

SEQ ID NO: 5297 - RNA, 20 nt, Artificial Sequence
  Chemically Synthesized
cuuaauuagcuccuuuggcu

SEQ ID NO: 5298 - RNA, 20 nt, Artificial Sequence
  Chemically Synthesized
gcaaguucaucucauuauca

SEQ ID NO: 5299 - RNA, 20 nt, Artificial Sequence
  Chemically Synthesized
uaagaaaaggcuguguauug

SEQ ID NO: 5300 - RNA, 20 nt, Artificial Sequence
  Chemically Synthesized
aagagaucaucuuuaagaaa

SEQ ID NO: 5301 - RNA, 20 nt, Artificial Sequence
  Chemically Synthesized
uccagaaucacacaaguuaa

SEQ ID NO: 5302 - RNA, 20 nt, Artificial Sequence
  Chemically Synthesized
gauucuaccaucaguccagu

SEQ ID NO: 5303 - RNA, 20 nt, Artificial Sequence
  Chemically Synthesized
ccugcaacugcaugguugaa

SEQ ID NO: 5304 - RNA, 20 nt, Artificial Sequence
  Chemically Synthesized
guugucaaugcggcugucac

SEQ ID NO: 5305 - RNA, 20 nt, Artificial Sequence
  Chemically Synthesized
aguauaacauguugucaaug

SEQ ID NO: 5306 - RNA, 20 nt, Artificial Sequence
  Chemically Synthesized
aaugguaaaauauugcuuca

SEQ ID NO: 5307 - RNA, 20 nt, Artificial Sequence
  Chemically Synthesized
uuauauucagguguguauau

SEQ ID NO: 5308 - RNA, 20 nt, Artificial Sequence
  Chemically Synthesized
caugaguaauaacuauaauu

SEQ ID NO: 5309 - RNA, 20 nt, Artificial Sequence
  Chemically Synthesized
cuccuguucccagcuccaag

SEQ ID NO: 5310 - RNA, 20 nt, Artificial Sequence
  Chemically Synthesized
uuuaacacuucccuagccaa

SEQ ID NO: 5311 - RNA, 20 nt, Artificial Sequence
  Chemically Synthesized
cagccugacucugauaaaaa

SEQ ID NO: 5312 - RNA, 20 nt, Artificial Sequence
  Chemically Synthesized
acucauguuuuacauaauug

SEQ ID NO: 5313 - RNA, 20 nt, Artificial Sequence
  Chemically Synthesized
agaaaccucugaaggcuaaa

SEQ ID NO: 5314 - RNA, 20 nt, Artificial Sequence
  Chemically Synthesized
uuugucaccaacuggacuga

SEQ ID NO: 5315 - RNA, 20 nt, Artificial Sequence
  Chemically Synthesized
cagagagcaaaaguaagaaa

SEQ ID NO: 5316 - RNA, 20 nt, Artificial Sequence
  Chemically Synthesized
aaaacugacugaucagucau

SEQ ID NO: 5317 - RNA, 20 nt, Artificial Sequence
  Chemically Synthesized
gcaaaugaaauuaucuuuua

SEQ ID NO: 5318 - RNA, 20 nt, Artificial Sequence
  Chemically Synthesized
uugcugugggcagaaaaggg

SEQ ID NO: 5319 - RNA, 20 nt, Artificial Sequence
  Chemically Synthesized
uuuacgaaacccaaucucag

SEQ ID NO: 5320 - RNA, 20 nt, Artificial Sequence
  Chemically Synthesized
uuaaagaugaucucuuaucu

SEQ ID NO: 5321 - RNA, 20 nt, Artificial Sequence
  Chemically Synthesized
uuaaagaugaucucuuaccu

SEQ ID NO: 5322 - RNA, 20 nt, Artificial Sequence
  Chemically Synthesized
cucuuaucuugggaaaggag

SEQ ID NO: 5323 - RNA, 20 nt, Artificial Sequence
  Chemically Synthesized
cucuuaccuugggaaaggag

SEQ ID NO: 5324 - RNA, 20 nt, Artificial Sequence
  Chemically Synthesized
augaucucuuaucuugggaa

SEQ ID NO: 5325 - RNA, 20 nt, Artificial Sequence
  Chemically Synthesized
augaucucuuaccuugggaa

SEQ ID NO: 5326 - RNA, 20 nt, Artificial Sequence
  Chemically Synthesized
uaaagaugaucucuuaucuu

SEQ ID NO: 5327 - RNA, 20 nt, Artificial Sequence
  Chemically Synthesized
uaaagaugaucucuuaccuu

SEQ ID NO: 5328 - RNA, 20 nt, Artificial Sequence
  Chemically Synthesized
ugaacaccucuccuuuccca

SEQ ID NO: 5329 - DNA, 20 bp, Artificial Sequence
  Chemically Synthesized
tccagttggtgacaaatacg

SEQ ID NO: 5330 - DNA, 20 bp, Artificial Sequence
  Chemically Synthesized
cacccacggagagcgctgta

SEQ ID NO: 5331 - DNA, 20 bp, Artificial Sequence
  Chemically Synthesized
atgagtaataactataattg

SEQ ID NO: 5332 - DNA, 20 bp, Artificial Sequence
  Chemically Synthesized
attttaagaattcagctgag

SEQ ID NO: 5333 - DNA, 20 bp, Artificial Sequence
  Chemically Synthesized
agtttgttctctgtgattgg

SEQ ID NO: 5334 - DNA, 20 bp, Artificial Sequence
  Chemically Synthesized
tcaactggcctgcaactgca

SEQ ID NO: 5335 - DNA, 20 bp, Artificial Sequence
  Chemically Synthesized
cctttcaaccatgcagttgc

SEQ ID NO: 5336 - DNA, 20 bp, Artificial Sequence
  Chemically Synthesized
gcatatgatgatagtattat

SEQ ID NO: 5337 - DNA, 20 bp, Artificial Sequence
  Chemically Synthesized
agtctgtgatctggacagaa

SEQ ID NO: 5338 - DNA, 20 bp, Artificial Sequence
  Chemically Synthesized
aacggaaagtagtttcattt

SEQ ID NO: 5339 - DNA, 20 bp, Artificial Sequence
  Chemically Synthesized
cccccaaatcccctgagatt

SEQ ID NO: 5340 - DNA, 20 bp, Artificial Sequence
  Chemically Synthesized
tcaatgcggctgtcactgga

SEQ ID NO: 5341 - DNA, 20 bp, Artificial Sequence
  Chemically Synthesized
atgaaatgacatgaaaaaga

SEQ ID NO: 5342 - DNA, 20 bp, Artificial Sequence
  Chemically Synthesized
caaccttacagcgctctccg

SEQ ID NO: 5343 - DNA, 20 bp, Artificial Sequence
  Chemically Synthesized
tcctgttcccagctccaaga

SEQ ID NO: 5344 - DNA, 20 bp, Artificial Sequence
  Chemically Synthesized
aatgcaaccactgctttgca

SEQ ID NO: 5345 - DNA, 20 bp, Artificial Sequence
  Chemically Synthesized
aggcacacagctcagctggc

SEQ ID NO: 5346 - DNA, 20 bp, Artificial Sequence
  Chemically Synthesized
ggggagactgggagtatgac

SEQ ID NO: 5347 - DNA, 20 bp, Artificial Sequence
  Chemically Synthesized
tttaacacttccctagccaa

SEQ ID NO: 5348 - DNA, 20 bp, Artificial Sequence
  Chemically Synthesized
tcgctgctcttgttgcagaa

SEQ ID NO: 5349 - DNA, 20 bp, Artificial Sequence
  Chemically Synthesized
gaaaaggctgtgtattgtgg

SEQ ID NO: 5350 - DNA, 20 bp, Artificial Sequence
  Chemically Synthesized
aagaaaaggctgtgtattgt

SEQ ID NO: 5351 - DNA, 20 bp, Artificial Sequence
  Chemically Synthesized
ttaattagctcctttggcta

SEQ ID NO: 5352 - DNA, 20 bp, Artificial Sequence
  Chemically Synthesized
aatgtatgctggcttttaag

SEQ ID NO: 5353 - DNA, 20 bp, Artificial Sequence
  Chemically Synthesized
taacttgtgtgattctggag

SEQ ID NO: 5354 - DNA, 20 bp, Artificial Sequence
  Chemically Synthesized
cttaattagctcctttggct

SEQ ID NO: 5355 - DNA, 20 bp, Artificial Sequence
  Chemically Synthesized
gcaagttcatctcattatca

SEQ ID NO: 5356 - DNA, 20 bp, Artificial Sequence
  Chemically Synthesized
taagaaaaggctgtgtattg

SEQ ID NO: 5357 - DNA, 20 bp, Artificial Sequence
  Chemically Synthesized
aagagatcatctttaagaaa

SEQ ID NO: 5358 - DNA, 20 bp, Artificial Sequence
  Chemically Synthesized
tccagaatcacacaagttaa

SEQ ID NO: 5359 - DNA, 20 bp, Artificial Sequence
  Chemically Synthesized
gattctaccatcagtccagt

SEQ ID NO: 5360 - DNA, 20 bp, Artificial Sequence
  Chemically Synthesized
cctgcaactgcatggttgaa

SEQ ID NO: 5361 - DNA, 20 bp, Artificial Sequence
  Chemically Synthesized
gttgtcaatgcggctgtcac

SEQ ID NO: 5362 - DNA, 20 bp, Artificial Sequence
  Chemically Synthesized
agtataacatgttgtcaatg

SEQ ID NO: 5363 - DNA, 20 bp, Artificial Sequence
  Chemically Synthesized
aatggtaaaatattgcttca

SEQ ID NO: 5364 - DNA, 20 bp, Artificial Sequence
  Chemically Synthesized
ttatattcaggtgtgtatat

SEQ ID NO: 5365 - DNA, 20 bp, Artificial Sequence
  Chemically Synthesized
catgagtaataactataatt

SEQ ID NO: 5366 - DNA, 20 bp, Artificial Sequence
  Chemically Synthesized
ctcctgttcccagctccaag

SEQ ID NO: 5367 - DNA, 20 bp, Artificial Sequence
  Chemically Synthesized
tttaacacttccctagccaa

SEQ ID NO: 5368 - DNA, 20 bp, Artificial Sequence
  Chemically Synthesized
cagcctgactctgataaaaa

SEQ ID NO: 5369 - DNA, 20 bp, Artificial Sequence
  Chemically Synthesized
actcatgttttacataattg

SEQ ID NO: 5370 - DNA, 20 bp, Artificial Sequence
  Chemically Synthesized
agaaacctctgaaggctaaa

SEQ ID NO: 5371 - DNA, 20 bp, Artificial Sequence
  Chemically Synthesized
tttgtcaccaactggactga

SEQ ID NO: 5372 - DNA, 20 bp, Artificial Sequence
  Chemically Synthesized
cagagagcaaaagtaagaaa

SEQ ID NO: 5373 - DNA, 20 bp, Artificial Sequence
  Chemically Synthesized
aaaactgactgatcagtcat

SEQ ID NO: 5374 - DNA, 20 bp, Artificial Sequence
  Chemically Synthesized
gcaaatgaaattatctttta

SEQ ID NO: 5375 - DNA, 20 bp, Artificial Sequence
  Chemically Synthesized
ttgctgtgggcagaaaaggg

SEQ ID NO: 5376 - DNA, 20 bp, Artificial Sequence
  Chemically Synthesized
tttacgaaacccaatctcag

SEQ ID NO: 5377 - DNA, 20 bp, Artificial Sequence
  Chemically Synthesized
ttaaagatgatctcttatct

SEQ ID NO: 5378 - DNA, 20 bp, Artificial Sequence
  Chemically Synthesized
ttaaagatgatctcttacct

SEQ ID NO: 5379 - DNA, 20 bp, Artificial Sequence
  Chemically Synthesized
ctcttatcttgggaaaggag

SEQ ID NO: 5380 - DNA, 20 bp, Artificial Sequence
  Chemically Synthesized
ctcttaccttgggaaaggag

SEQ ID NO: 5381 - DNA, 20 bp, Artificial Sequence
  Chemically Synthesized
atgatctcttatcttgggaa

SEQ ID NO: 5382 - DNA, 20 bp, Artificial Sequence
  Chemically Synthesized
atgatctcttaccttgggaa

SEQ ID NO: 5383 - DNA, 20 bp, Artificial Sequence
  Chemically Synthesized
taaagatgatctcttatctt

SEQ ID NO: 5384 - DNA, 20 bp, Artificial Sequence
  Chemically Synthesized
taaagatgatctcttacctt

SEQ ID NO: 5385 - DNA, 20 bp, Artificial Sequence
  Chemically Synthesized
tgaacacctctcctttccca

SEQ ID NO: 5386 - DNA, 20 bp, Artificial Sequence
  Chemically Synthesized
cgtatttgtcaccaactgga

SEQ ID NO: 5387 - DNA, 20 bp, Artificial Sequence
  Chemically Synthesized
tacagcgctctccgtgggtg

SEQ ID NO: 5388 - DNA, 20 bp, Artificial Sequence
  Chemically Synthesized
caattatagttattactcat

SEQ ID NO: 5389 - DNA, 20 bp, Artificial Sequence
  Chemically Synthesized
ctcagctgaattcttaaaat

SEQ ID NO: 5390 - DNA, 20 bp, Artificial Sequence
  Chemically Synthesized
ccaatcacagagaacaaact

SEQ ID NO: 5391 - DNA, 20 bp, Artificial Sequence
  Chemically Synthesized
tgcagttgcaggccagttga

SEQ ID NO: 5392 - DNA, 20 bp, Artificial Sequence
  Chemically Synthesized
gcaactgcatggttgaaagg

SEQ ID NO: 5393 - DNA, 20 bp, Artificial Sequence
  Chemically Synthesized
ataatactatcatcatatgc

SEQ ID NO: 5394 - DNA, 20 bp, Artificial Sequence
  Chemically Synthesized
ttctgtccagatcacagact

SEQ ID NO: 5395 - DNA, 20 bp, Artificial Sequence
  Chemically Synthesized
aaatgaaactactttccgtt

SEQ ID NO: 5396 - DNA, 20 bp, Artificial Sequence
  Chemically Synthesized
aatctcaggggatttggggg

SEQ ID NO: 5397 - DNA, 20 bp, Artificial Sequence
  Chemically Synthesized
tccagtgacagccgcattga

SEQ ID NO: 5398 - DNA, 20 bp, Artificial Sequence
  Chemically Synthesized
tctttttcatgtcatttcat

SEQ ID NO: 5399 - DNA, 20 bp, Artificial Sequence
  Chemically Synthesized
cggagagcgctgtaaggttg

SEQ ID NO: 5400 - DNA, 20 bp, Artificial Sequence
  Chemically Synthesized
tcttggagctgggaacagga

SEQ ID NO: 5401 - DNA, 20 bp, Artificial Sequence
  Chemically Synthesized
tgcaaagcagtggttgcatt

SEQ ID NO: 5402 - DNA, 20 bp, Artificial Sequence
  Chemically Synthesized
gccagctgagctgtgtgcct

SEQ ID NO: 5403 - DNA, 20 bp, Artificial Sequence
  Chemically Synthesized
gtcatactcccagtctcccc

SEQ ID NO: 5404 - DNA, 20 bp, Artificial Sequence
  Chemically Synthesized
ttggctagggaagtgttaaa

SEQ ID NO: 5405 - DNA, 20 bp, Artificial Sequence
  Chemically Synthesized
ttctgcaacaagagcagcga

SEQ ID NO: 5406 - DNA, 20 bp, Artificial Sequence
  Chemically Synthesized
ccacaatacacagccttttc

SEQ ID NO: 5407 - DNA, 20 bp, Artificial Sequence
  Chemically Synthesized
acaatacacagccttttctt

SEQ ID NO: 5408 - DNA, 20 bp, Artificial Sequence
  Chemically Synthesized
tagccaaaggagctaattaa

SEQ ID NO: 5409 - DNA, 20 bp, Artificial Sequence
  Chemically Synthesized
cttaaaagccagcatacatt

SEQ ID NO: 5410 - DNA, 20 bp, Artificial Sequence
  Chemically Synthesized
ctccagaatcacacaagtta

SEQ ID NO: 5411 - DNA, 20 bp, Artificial Sequence
  Chemically Synthesized
agccaaaggagctaattaag

SEQ ID NO: 5412 - DNA, 20 bp, Artificial Sequence
  Chemically Synthesized
tgataatgagatgaacttgc

SEQ ID NO: 5413 - DNA, 20 bp, Artificial Sequence
  Chemically Synthesized
caatacacagccttttctta

SEQ ID NO: 5414 - DNA, 20 bp, Artificial Sequence
  Chemically Synthesized
tttcttaaagatgatctctt

SEQ ID NO: 5415 - DNA, 20 bp, Artificial Sequence
  Chemically Synthesized
ttaacttgtgtgattctgga

SEQ ID NO: 5416 - DNA, 20 bp, Artificial Sequence
  Chemically Synthesized
actggactgatggtagaatc

SEQ ID NO: 5417 - DNA, 20 bp, Artificial Sequence
  Chemically Synthesized
ttcaaccatgcagttgcagg

SEQ ID NO: 5418 - DNA, 20 bp, Artificial Sequence
  Chemically Synthesized
gtgacagccgcattgacaac

SEQ ID NO: 5419 - DNA, 20 bp, Artificial Sequence
  Chemically Synthesized
cattgacaacatgttatact

SEQ ID NO: 5420 - DNA, 20 bp, Artificial Sequence
  Chemically Synthesized
tgaagcaatattttaccatt

SEQ ID NO: 5421 - DNA, 20 bp, Artificial Sequence
  Chemically Synthesized
atatacacacctgaatataa

SEQ ID NO: 5422 - DNA, 20 bp, Artificial Sequence
  Chemically Synthesized
aattatagttattactcatg

SEQ ID NO: 5423 - DNA, 20 bp, Artificial Sequence
  Chemically Synthesized
cttggagctgggaacaggag

SEQ ID NO: 5424 - DNA, 20 bp, Artificial Sequence
  Chemically Synthesized
ttggctagggaagtgttaaa

SEQ ID NO: 5425 - DNA, 20 bp, Artificial Sequence
  Chemically Synthesized
tttttatcagagtcaggctg

SEQ ID NO: 5426 - DNA, 20 bp, Artificial Sequence
  Chemically Synthesized
caattatgtaaaacatgagt

SEQ ID NO: 5427 - DNA, 20 bp, Artificial Sequence
  Chemically Synthesized
tttagccttcagaggtttct

SEQ ID NO: 5428 - DNA, 20 bp, Artificial Sequence
  Chemically Synthesized
tcagtccagttggtgacaaa

SEQ ID NO: 5429 - DNA, 20 bp, Artificial Sequence
  Chemically Synthesized
tttcttacttttgctctctg

SEQ ID NO: 5430 - DNA, 20 bp, Artificial Sequence
  Chemically Synthesized
atgactgatcagtcagtttt

SEQ ID NO: 5431 - DNA, 20 bp, Artificial Sequence
  Chemically Synthesized
taaaagataatttcatttgc

SEQ ID NO: 5432 - DNA, 20 bp, Artificial Sequence
  Chemically Synthesized
cccttttctgcccacagcaa

SEQ ID NO: 5433 - DNA, 20 bp, Artificial Sequence
  Chemically Synthesized
ctgagattgggtttcgtaaa

SEQ ID NO: 5434 - DNA, 20 bp, Artificial Sequence
  Chemically Synthesized
agataagagatcatctttaa

SEQ ID NO: 5435 - DNA, 20 bp, Artificial Sequence
  Chemically Synthesized
aggtaagagatcatctttaa

SEQ ID NO: 5436 - DNA, 20 bp, Artificial Sequence
  Chemically Synthesized
ctcctttcccaagataagag

SEQ ID NO: 5437 - DNA, 20 bp, Artificial Sequence
  Chemically Synthesized
ctcctttcccaaggtaagag

SEQ ID NO: 5438 - DNA, 20 bp, Artificial Sequence
  Chemically Synthesized
ttcccaagataagagatcat

SEQ ID NO: 5439 - DNA, 20 bp, Artificial Sequence
  Chemically Synthesized
ttcccaaggtaagagatcat

SEQ ID NO: 5440 - DNA, 20 bp, Artificial Sequence
  Chemically Synthesized
aagataagagatcatcttta

SEQ ID NO: 5441 - DNA, 20 bp, Artificial Sequence
  Chemically Synthesized
aaggtaagagatcatcttta

SEQ ID NO: 5442 - DNA, 20 bp, Artificial Sequence
  Chemically Synthesized
tgggaaaggagaggtgttca

SEQ ID NO: 5443 - RNA, 18 nt, Artificial Sequence
  Chemically Synthesized
auaugaugauaguauuau

SEQ ID NO: 5444 - DNA, 18 bp, Artificial Sequence
  Chemically Synthesized
atatgatgatagtattat

SEQ ID NO: 5445 - DNA, 18 bp, Artificial Sequence
  Chemically Synthesized
ataatactatcatcatat

SEQ ID NO: 5446 - RNA, 20 nt, Artificial Sequence
  Chemically Synthesized
acaaccuuacagcgcucucc

SEQ ID NO: 5447 - RNA, 20 nt, Artificial Sequence
  Chemically Synthesized
caguuugaaugacucacaac

SEQ ID NO: 5448 - RNA, 20 nt, Artificial Sequence
  Chemically Synthesized
ugcaaguucaucucauuauc

SEQ ID NO: 5449 - RNA, 20 nt, Artificial Sequence
  Chemically Synthesized
cacuaaauugaaagagugcc

SEQ ID NO: 5450 - RNA, 20 nt, Artificial Sequence
  Chemically Synthesized
gcugcuuucagcuuccucuc

SEQ ID NO: 5451 - RNA, 20 nt, Artificial Sequence
  Chemically Synthesized
uagcuaucacuuucuaaagu

SEQ ID NO: 5452 - RNA, 20 nt, Artificial Sequence
  Chemically Synthesized
uaagguuagacauuaaagac

SEQ ID NO: 5453 - RNA, 20 nt, Artificial Sequence
  Chemically Synthesized
cucacccucucuuccccaaa

SEQ ID NO: 5454 - RNA, 20 nt, Artificial Sequence
  Chemically Synthesized
auuacucucuuuggggaaga

SEQ ID NO: 5455 - RNA, 20 nt, Artificial Sequence
  Chemically Synthesized
uuucccagagaaaagcaagu

SEQ ID NO: 5456 - RNA, 20 nt, Artificial Sequence
  Chemically Synthesized
uagugcuuuaaaaugauaag

SEQ ID NO: 5457 - RNA, 20 nt, Artificial Sequence
  Chemically Synthesized
acaugaguaauaacuauaau

SEQ ID NO: 5458 - RNA, 20 nt, Artificial Sequence
  Chemically Synthesized
acuuucuaaaguaagaauuc

SEQ ID NO: 5459 - RNA, 20 nt, Artificial Sequence
  Chemically Synthesized
agcaauuauuauaucaaaau

SEQ ID NO: 5460 - RNA, 20 nt, Artificial Sequence
  Chemically Synthesized
aguaauauacacuuaaaaau

SEQ ID NO: 5461 - RNA, 20 nt, Artificial Sequence
  Chemically Synthesized
agaugguuauaaaauuuuaa

SEQ ID NO: 5462 - DNA, 20 bp, Artificial Sequence
  Chemically Synthesized
acaaccttacagcgctctcc

SEQ ID NO: 5463 - DNA, 20 bp, Artificial Sequence
  Chemically Synthesized
cagtttgaatgactcacaac

SEQ ID NO: 5464 - DNA, 20 bp, Artificial Sequence
  Chemically Synthesized
tgcaagttcatctcattatc

SEQ ID NO: 5465 - DNA, 20 bp, Artificial Sequence
  Chemically Synthesized
cactaaattgaaagagtgcc

SEQ ID NO: 5466 - DNA, 20 bp, Artificial Sequence
  Chemically Synthesized
gctgctttcagcttcctctc

SEQ ID NO: 5467 - DNA, 20 bp, Artificial Sequence
  Chemically Synthesized
tagctatcactttctaaagt

SEQ ID NO: 5468 - DNA, 20 bp, Artificial Sequence
  Chemically Synthesized
taaggttagacattaaagac

SEQ ID NO: 5469 - DNA, 20 bp, Artificial Sequence
  Chemically Synthesized
ctcaccctctcttccccaaa

SEQ ID NO: 5470 - DNA, 20 bp, Artificial Sequence
  Chemically Synthesized
attactctctttggggaaga

SEQ ID NO: 5471 - DNA, 20 bp, Artificial Sequence
  Chemically Synthesized
tttcccagagaaaagcaagt

SEQ ID NO: 5472 - DNA, 20 bp, Artificial Sequence
  Chemically Synthesized
tagtgctttaaaatgataag

SEQ ID NO: 5473 - DNA, 20 bp, Artificial Sequence
  Chemically Synthesized
acatgagtaataactataat

SEQ ID NO: 5474 - DNA, 20 bp, Artificial Sequence
  Chemically Synthesized
actttctaaagtaagaattc

SEQ ID NO: 5475 - DNA, 20 bp, Artificial Sequence
  Chemically Synthesized
agcaattattatatcaaaat

SEQ ID NO: 5476 - DNA, 20 bp, Artificial Sequence
  Chemically Synthesized
agtaatatacacttaaaaat

SEQ ID NO: 5477 - DNA, 20 bp, Artificial Sequence
  Chemically Synthesized
agatggttataaaattttaa

SEQ ID NO: 5478 - DNA, 20 bp, Artificial Sequence
  Chemically Synthesized
ggagagcgctgtaaggttgt

SEQ ID NO: 5479 - DNA, 20 bp, Artificial Sequence
  Chemically Synthesized
gttgtgagtcattcaaactg

SEQ ID NO: 5480 - DNA, 20 bp, Artificial Sequence
  Chemically Synthesized
gataatgagatgaacttgca

SEQ ID NO: 5481 - DNA, 20 bp, Artificial Sequence
  Chemically Synthesized
ggcactctttcaatttagtg

SEQ ID NO: 5482 - DNA, 20 bp, Artificial Sequence
  Chemically Synthesized
gagaggaagctgaaagcagc

SEQ ID NO: 5483 - DNA, 20 bp, Artificial Sequence
  Chemically Synthesized
actttagaaagtgatagcta

SEQ ID NO: 5484 - DNA, 20 bp, Artificial Sequence
  Chemically Synthesized
gtctttaatgtctaacctta

SEQ ID NO: 5485 - DNA, 20 bp, Artificial Sequence
  Chemically Synthesized
tttggggaagagagggtgag

SEQ ID NO: 5486 - DNA, 20 bp, Artificial Sequence
  Chemically Synthesized
tcttccccaaagagagtaat

SEQ ID NO: 5487 - DNA, 20 bp, Artificial Sequence
  Chemically Synthesized
acttgcttttctctgggaaa

SEQ ID NO: 5488 - DNA, 20 bp, Artificial Sequence
  Chemically Synthesized
cttatcattttaaagcacta

SEQ ID NO: 5489 - DNA, 20 bp, Artificial Sequence
  Chemically Synthesized
attatagttattactcatgt

SEQ ID NO: 5490 - DNA, 20 bp, Artificial Sequence
  Chemically Synthesized
gaattcttactttagaaagt

SEQ ID NO: 5491 - DNA, 20 bp, Artificial Sequence
  Chemically Synthesized
attttgatataataattgct

SEQ ID NO: 5492 - DNA, 20 bp, Artificial Sequence
  Chemically Synthesized
atttttaagtgtatattact

SEQ ID NO: 5493 - DNA, 20 bp, Artificial Sequence
  Chemically Synthesized
ttaaaattttataaccatct

SEQ ID NO: 5494 - DNA, 101 bp, Artificial Sequence
  Chemically Synthesized
gcacttcaaacccccacaatacacagccttttcttaaagatgatctcttaccttgggaaaggagaggtgttcaatttcaatttcatgatttgtttccccct

SEQ ID NO: 5495 - DNA, 24 bp, Artificial Sequence
  Chemically Synthesized
agttgcaggccagttgatttgtat

SEQ ID NO: 5496 - DNA, 24 bp, Artificial Sequence
  Chemically Synthesized
caaaatggggatacagctcctttc

SEQ ID NO: 5497 - DNA, 24 bp, Artificial Sequence
  Chemically Synthesized
atcaaaatggggatacagctcctt

SEQ ID NO: 5498 - DNA, 12 bp, Artificial Sequence
  Chemically Synthesized
gatccacgatgc

SEQ ID NO: 5499 - DNA, 20 bp, Artificial Sequence
  Chemically Synthesized
ggtgacagctgccaggatcg

SEQ ID NO: 5500 - DNA, 20 bp, Artificial Sequence
  Chemically Synthesized
gccacctccagtgccaaggt

SEQ ID NO: 5501 - DNA, 21 bp, Artificial Sequence
  Chemically Synthesized
ccagagcaggaagctaataaa

SEQ ID NO: 5502 - DNA, 25 bp, Artificial Sequence
  Chemically Synthesized
aattgaacacctctcctttcccaag

SEQ ID NO: 5503 - DNA, 21 bp, Artificial Sequence
  Chemically Synthesized
gatgaacttgcacttcaaacc

SEQ ID NO: 5504 - DNA, 21 bp, Artificial Sequence
  Chemically Synthesized
acctacctatgttaccactca

SEQ ID NO: 5505 - DNA, 25 bp, Artificial Sequence
  Chemically Synthesized
cttagtggaatcacagacaatgggc

SEQ ID NO: 5506 - DNA, 22 bp, Artificial Sequence
  Chemically Synthesized
gtcaccttctcttacctcaaat

SEQ ID NO: 5507 - DNA, 5501 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgacaaccttacagcgctctccgtttaagtactctgtgctggaaacagcacagaatctacttaaacaaggcaaaatgccgtgtttatctcgtcaacttgttggcgagattttttgctagcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaattaaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagcttaagaattcatcagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5508 - DNA, 5501 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgcagtttgaatgactcacaacgtttaagtactctgtgctggaaacagcacagaatctacttaaacaaggcaaaatgccgtgtttatctcgtcaacttgttggcgagattttttgctagcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaattaaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagcttaagaattcatcagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5509 - DNA, 5501 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtgcaagttcatctcattatcgtttaagtactctgtgctggaaacagcacagaatctacttaaacaaggcaaaatgccgtgtttatctcgtcaacttgttggcgagattttttgctagcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaattaaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagcttaagaattcatcagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5510 - DNA, 5501 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgcactaaattgaaagagtgccgtttaagtactctgtgctggaaacagcacagaatctacttaaacaaggcaaaatgccgtgtttatctcgtcaacttgttggcgagattttttgctagcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaattaaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagcttaagaattcatcagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5511 - DNA, 5501 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccggctgctttcagcttcctctcgtttaagtactctgtgctggaaacagcacagaatctacttaaacaaggcaaaatgccgtgtttatctcgtcaacttgttggcgagattttttgctagcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaattaaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagcttaagaattcatcagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5512 - DNA, 5501 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtagctatcactttctaaagtgtttaagtactctgtgctggaaacagcacagaatctacttaaacaaggcaaaatgccgtgtttatctcgtcaacttgttggcgagattttttgctagcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaattaaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagcttaagaattcatcagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5513 - DNA, 5501 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtaaggttagacattaaagacgtttaagtactctgtgctggaaacagcacagaatctacttaaacaaggcaaaatgccgtgtttatctcgtcaacttgttggcgagattttttgctagcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaattaaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagcttaagaattcatcagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5514 - DNA, 5501 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgctcaccctctcttccccaaagtttaagtactctgtgctggaaacagcacagaatctacttaaacaaggcaaaatgccgtgtttatctcgtcaacttgttggcgagattttttgctagcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaattaaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagcttaagaattcatcagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5515 - DNA, 5501 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgattactctctttggggaagagtttaagtactctgtgctggaaacagcacagaatctacttaaacaaggcaaaatgccgtgtttatctcgtcaacttgttggcgagattttttgctagcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaattaaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagcttaagaattcatcagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5516 - DNA, 5501 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtttcccagagaaaagcaagtgtttaagtactctgtgctggaaacagcacagaatctacttaaacaaggcaaaatgccgtgtttatctcgtcaacttgttggcgagattttttgctagcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaattaaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagcttaagaattcatcagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5517 - DNA, 5501 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtagtgctttaaaatgataaggtttaagtactctgtgctggaaacagcacagaatctacttaaacaaggcaaaatgccgtgtttatctcgtcaacttgttggcgagattttttgctagcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaattaaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagcttaagaattcatcagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5518 - DNA, 5501 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgacatgagtaataactataatgtttaagtactctgtgctggaaacagcacagaatctacttaaacaaggcaaaatgccgtgtttatctcgtcaacttgttggcgagattttttgctagcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaattaaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagcttaagaattcatcagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5519 - DNA, 5501 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgactttctaaagtaagaattcgtttaagtactctgtgctggaaacagcacagaatctacttaaacaaggcaaaatgccgtgtttatctcgtcaacttgttggcgagattttttgctagcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaattaaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagcttaagaattcatcagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5520 - DNA, 5501 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgagcaattattatatcaaaatgtttaagtactctgtgctggaaacagcacagaatctacttaaacaaggcaaaatgccgtgtttatctcgtcaacttgttggcgagattttttgctagcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaattaaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagcttaagaattcatcagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5521 - DNA, 5501 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgagtaatatacacttaaaaatgtttaagtactctgtgctggaaacagcacagaatctacttaaacaaggcaaaatgccgtgtttatctcgtcaacttgttggcgagattttttgctagcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaattaaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagcttaagaattcatcagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5522 - DNA, 5501 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgagatggttataaaattttaagtttaagtactctgtgctggaaacagcacagaatctacttaaacaaggcaaaatgccgtgtttatctcgtcaacttgttggcgagattttttgctagcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaattaaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagcttaagaattcatcagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5523 - DNA, 5501 bp, Artificial Sequence
  Plasmid
  misc_feature (395)..(414): N can be A, G, T, or C.
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgnnnnnnnnnnnnnnnnnnnngtttaagtactctgtgctggaaacagcacagaatctacttaaacaaggcaaaatgccgtgtttatctcgtcaacttgttggcgagattttttgctagcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaattaaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagcttaagaattcatcagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcgataccgagcgctctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5524 - DNA, 7254 bp, Artificial Sequence
  Plasmid
tcaggatatagtagtttcgcttttgcatagggagggggaaatgtagtcttatgcaatactcttgtagtcttgcaacatgcttatgtaacgatgagttagcaacatgccttataaggagagaaaaagcaccgtgcatgccgattggtgggagtaaggtggtatgatcgtggtatgatcgtgccttgttaggaaggcaacagacgggtctaacacggattggacgaaccactgaattccgcattgcagagatattgtatttaagtgcctagctcgatacaataaacgccatttgaccattcaccacattggtgtgcacctcaagcttcctgcatgctgctgctgctgctgctgctgggcctgaggctacagctctccctgggcatcatcccagttgaggaggagaacccggacttctggaaccgcgaggcagccgaggccctgggtgccgccaagaagctgcagcctgcacagacagccgccaagaacctcatcatcttcctgggcgatgggatgggggtgtctacggtgacagctgccaggatcgatctgcttcctggccctgctgggcctgctcatcctctgggagccctggcctgcccaggcttttgtcaacagcacctttgtggttctcacttggtggaagctctctacctggtgtgtggggagcgtggattcttctacacacccatgtcccgccgcgaagtggaggacccacaaggtaagctctgctcctgaattaattctatcccaagtgctaactaccctgtttgtctttcacccttgagaccttgtaaattgtgccctaggtgtggagggtctcaggctaaccagtggggggcacatttctgtgggcagctagacatatgtaaacatggtagctgccaggaaggagtgagaatccttccttaagtctcctaggtggtgacgggtggctaggccccaggataggtaccgggccccccctcgagcattaaataatgttacttatgttatacagcccatttccttttttatcagagtcaggctgaaagttcatttttctgcaaaactgcagtgcccattcttaatttttgttttgagaaataactgttgtaccctctttattatcacaagattaataatatttctttattttattgctcctcttacatttggatcttttattatgagctgtcaaaaattcttttgggaagtagttggggtataaataataaatcgataaaagaattcatgattaaagacaagatagaatccattattctgttaacatatcagtagtgaataacaaaaggctacattgacaattagcatgcaatatattgctttatataattatacatccatatatttgccactttgatttttaattcactggtaaatttaggggatactcatttatggagttaatattaccaaaaagagtttttaaactgagcgaggctttaattagaatggtaaaatattgcttcagggcaacaatgagaatgtaacaagaaaactgactgatcagtcatgggtaactcgaatagcaaacaagtagagaagactcacaaaaccactgaaagttatatacacactcaagttgtgagtcattcaaactgggtattcatacacatgtatacaaatacaaacaagtgtgtgcgcacacaccctttccaatatacacacctgaatataaaactaaataagcagattcctctgttaacaattttattactctattttaggctggggctgaacttttgaagctgatgagcaaaatagtttcccataaaagataatttcatttgccaaaatgaaactactttccgttattaatgttgcaatgaaatggtttgaaatatgagtctgtgatctggacagaaaggatgctcctgttcccagctccaagagggagttctctaaacaattacacccacggagagcgctgtaaggttgtattttcatcaccggccagctgagctgtgtgcctgtcatactcccagtctcccctccagtgacagccgcattgacaacatgttatactccacattgattttacagttaaggagctgattgtgatatatagagattttaagaattcagctgagaggctgacttttgccttttatcattccattaaaattttataaccatctttttcatgtcatttcatccatgaattcttactttagaaagtgatagctactgctgtgagcataacttttctcatgttcagagctttttattgtattagcaaactaccccaattatagttattactcatgttttacataattgtggtggccctttcaaccatgcagttgcaggccagttgatttgtatatagaattagatgattcggcttatcattttaaagcactaaattgaaagagtgccaggagtcaggttttaacacttccctagccaaaggagctaattaagctgctttcagcttcctctccagaatcacacaagttaaaggacccttctgcaacaagagcagcgaatctactcagccagagcaggaagctaataaaatgtatgctggcttttaagggggaaacaaatcatgaaattgaaattgaacacctctcctttcccaagataagagatcatctttaagaaaaggctgtgtattgtgggggtttgaagtgcaagttcatctcattatcatggatgtttcacccataatactatcatcatatgcaggagaaataaaagccttatcccccaatcacagagaacaaactgcatcattgttgtttcttttccctgaagatgctcacagtttgatagttcacatatgaggaataattatgcaagacccagatgaaaaccctaataaaaaatattctgatttttaagtgtatattactctctttggggaagagagggtgagataaggttagacattaaagacttgaatctccaccattgattttacgaaacccaatctcaggggatttgggggtttttttagatttcaaaacaacattgatatcttacaagactcgtacttgcttttctctgggaaatagccaaatctagatgacaagcataaataagaaaggagctgtatccccattttgatataataattgctactgctactgtataccagagagcaaaagtaagaaatggcatagtggttttaagaaagctttaaaatgaaagctaacaagagactgaaacggaaagtgtgatttataccatgactgctggttttagggttttttttagggatttctcttcaaataggatacattaccaaattgtcagaaatagcttgatttcagagttagtgcactataacatcttttgcttcgaaaagtgattatgattctaccatcagtccagttggtgacaaatacgtggatcctgttgtgtgaaagtgtactcatataaccaactattattgcagtcactggccctgcaaagcagtggttgcatttaaaatttcaaccttctttgtaacactgaatcgcatacacacactcacaagatcaacgctgttttaaacaattactaaatccaagtatatcttttttaaagattttcaataaaatctaatgttcacagaaaaatctcataaatgtcaaaattgctgtgggcagaaaaggggggatacagtattttcttgatctgttttagcaatttatagatttcaggccgtggtttataagaatgctaaatgttctggaattacagctgttactgatcagtgattgagccagatttgtgttattgcaccatgttcttgcttgtacctagagagcagtaaagcctcaatataataaaaagcacctgcattttaaatgaaatttcaattgaaaaacttaacagcccttcaaattgcagaatttaacgcagcccagtaaagcttaaataacactttgcccccgcaggctgaggggtttgcattcaaggtgacttgattgtgtcgcatggtgaaattatttacaattaaggaatttctctggagggctgcagaatatttgctgttccacaacacctatgcaggcatatggtgggcctttttcagtattcatggagcctcctgaacctttatgataattgaatcagttagagtgctgagtggagcaagcataaaacctgttaacctaaaggtcagatctgagctcggtacctatttggggaccccatagagcactgcactgactgagggatggtaacaggatgtgtaggttttggaggcccatatgtccattcatgaccagtgacttgtctcacagccatgcaacccttgcctcctgtgctgacttagcaggggataaagtgagagaaagcctgggctaatcagggggtcgctcagctcctcctaactggattgtcctatgtgtctttgcttctgtgctgctgatgctctgccctgtgctgacatgacctccctggcagtggcacaactggagctgggtggaggcccgtgaccttcagaccttggcactggaggtggcccggcagaagcgcggcatcgtggatcagtgctgcaccagcatctgctctctctaccaactggagaactactgcaactaggcccaccactaccctgtccacccctctgcaatgaataaaacctttgaaagagcactacaagttgtgtgtacatgcgtgcatgtgcatatgtggtgcggggggaacatgagtggggctggctggagtggcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacggagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcggggagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatc

SEQ ID NO: 5525 - DNA, 7254 bp, Artificial Sequence
  Plasmid
tcaggatatagtagtttcgcttttgcatagggagggggaaatgtagtcttatgcaatactcttgtagtcttgcaacatgcttatgtaacgatgagttagcaacatgccttataaggagagaaaaagcaccgtgcatgccgattggtgggagtaaggtggtatgatcgtggtatgatcgtgccttgttaggaaggcaacagacgggtctaacacggattggacgaaccactgaattccgcattgcagagatattgtatttaagtgcctagctcgatacaataaacgccatttgaccattcaccacattggtgtgcacctcaagcttcctgcatgctgctgctgctgctgctgctgggcctgaggctacagctctccctgggcatcatcccagttgaggaggagaacccggacttctggaaccgcgaggcagccgaggccctgggtgccgccaagaagctgcagcctgcacagacagccgccaagaacctcatcatcttcctgggcgatgggatgggggtgtctacggtgacagctgccaggatcgatctgcttcctggccctgctgggcctgctcatcctctgggagccctggcctgcccaggcttttgtcaacagcacctttgtggttctcacttggtggaagctctctacctggtgtgtggggagcgtggattcttctacacacccatgtcccgccgcgaagtggaggacccacaaggtaagctctgctcctgaattaattctatcccaagtgctaactaccctgtttgtctttcacccttgagaccttgtaaattgtgccctaggtgtggagggtctcaggctaaccagtggggggcacatttctgtgggcagctagacatatgtaaacatggtagctgccaggaaggagtgagaatccttccttaagtctcctaggtggtgacgggtggctaggccccaggataggtaccgggccccccctcgagcattaaataatgttacttatgttatacagcccatttccttttttatcagagtcaggctgaaagttcatttttctgcaaaactgcagtgcccattcttaatttttgttttgagaaataactgttgtaccctctttattatcacaagattaataatatttctttattttattgctcctcttacatttggatcttttattatgagctgtcaaaaattcttttgggaagtagttggggtataaataataaatcgataaaagaattcatgattaaagacaagatagaatccattattctgttaacatatcagtagtgaataacaaaaggctacattgacaattagcatgcaatatattgctttatataattatacatccatatatttgccactttgatttttaattcactggtaaatttaggggatactcatttatggagttaatattaccaaaaagagtttttaaactgagcgaggctttaattagaatggtaaaatattgcttcagggcaacaatgagaatgtaacaagaaaactgactgatcagtcatgggtaactcgaatagcaaacaagtagagaagactcacaaaaccactgaaagttatatacacactcaagttgtgagtcattcaaactgggtattcatacacatgtatacaaatacaaacaagtgtgtgcgcacacaccctttccaatatacacacctgaatataaaactaaataagcagattcctctgttaacaattttattactctattttaggctggggctgaacttttgaagctgatgagcaaaatagtttcccataaaagataatttcatttgccaaaatgaaactactttccgttattaatgttgcaatgaaatggtttgaaatatgagtctgtgatctggacagaaaggatgctcctgttcccagctccaagagggagttctctaaacaattacacccacggagagcgctgtaaggttgtattttcatcaccggccagctgagctgtgtgcctgtcatactcccagtctcccctccagtgacagccgcattgacaacatgttatactccacattgattttacagttaaggagctgattgtgatatatagagattttaagaattcagctgagaggctgacttttgccttttatcattccattaaaattttataaccatctttttcatgtcatttcatccatgaattcttactttagaaagtgatagctactgctgtgagcataacttttctcatgttcagagctttttattgtattagcaaactaccccaattatagttattactcatgttttacataattgtggtggccctttcaaccatgcagttgcaggccagttgatttgtatatagaattagatgattcggcttatcattttaaagcactaaattgaaagagtgccaggagtcaggttttaacacttccctagccaaaggagctaattaagctgctttcagcttcctctccagaatcacacaagttaaaggacccttctgcaacaagagcagcgaatctactcagccagagcaggaagctaataaaatgtatgctggcttttaagggggaaacaaatcatgaaattgaaattgaacacctctcctttcccaaggtaagagatcatctttaagaaaaggctgtgtattgtgggggtttgaagtgcaagttcatctcattatcatggatgtttcacccataatactatcatcatatgcaggagaaataaaagccttatcccccaatcacagagaacaaactgcatcattgttgtttcttttccctgaagatgctcacagtttgatagttcacatatgaggaataattatgcaagacccagatgaaaaccctaataaaaaatattctgatttttaagtgtatattactctctttggggaagagagggtgagataaggttagacattaaagacttgaatctccaccattgattttacgaaacccaatctcaggggatttgggggtttttttagatttcaaaacaacattgatatcttacaagactcgtacttgcttttctctgggaaatagccaaatctagatgacaagcataaataagaaaggagctgtatccccattttgatataataattgctactgctactgtataccagagagcaaaagtaagaaatggcatagtggttttaagaaagctttaaaatgaaagctaacaagagactgaaacggaaagtgtgatttataccatgactgctggttttagggttttttttagggatttctcttcaaataggatacattaccaaattgtcagaaatagcttgatttcagagttagtgcactataacatcttttgcttcgaaaagtgattatgattctaccatcagtccagttggtgacaaatacgtggatcctgttgtgtgaaagtgtactcatataaccaactattattgcagtcactggccctgcaaagcagtggttgcatttaaaatttcaaccttctttgtaacactgaatcgcatacacacactcacaagatcaacgctgttttaaacaattactaaatccaagtatatcttttttaaagattttcaataaaatctaatgttcacagaaaaatctcataaatgtcaaaattgctgtgggcagaaaaggggggatacagtattttcttgatctgttttagcaatttatagatttcaggccgtggtttataagaatgctaaatgttctggaattacagctgttactgatcagtgattgagccagatttgtgttattgcaccatgttcttgcttgtacctagagagcagtaaagcctcaatataataaaaagcacctgcattttaaatgaaatttcaattgaaaaacttaacagcccttcaaattgcagaatttaacgcagcccagtaaagcttaaataacactttgcccccgcaggctgaggggtttgcattcaaggtgacttgattgtgtcgcatggtgaaattatttacaattaaggaatttctctggagggctgcagaatatttgctgttccacaacacctatgcaggcatatggtgggcctttttcagtattcatggagcctcctgaacctttatgataattgaatcagttagagtgctgagtggagcaagcataaaacctgttaacctaaaggtcagatctgagctcggtacctatttggggaccccatagagcactgcactgactgagggatggtaacaggatgtgtaggttttggaggcccatatgtccattcatgaccagtgacttgtctcacagccatgcaacccttgcctcctgtgctgacttagcaggggataaagtgagagaaagcctgggctaatcagggggtcgctcagctcctcctaactggattgtcctatgtgtctttgcttctgtgctgctgatgctctgccctgtgctgacatgacctccctggcagtggcacaactggagctgggtggaggcccgtgaccttcagaccttggcactggaggtggcccggcagaagcgcggcatcgtggatcagtgctgcaccagcatctgctctctctaccaactggagaactactgcaactaggcccaccactaccctgtccacccctctgcaatgaataaaacctttgaaagagcactacaagttgtgtgtacatgcgtgcatgtgcatatgtggtgcggggggaacatgagtggggctggctggagtggcgatgataagctgtcaaacatgagaattcttgaagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacggagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcggggagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggatc

SEQ ID NO: 5526 - RNA, 122 nt, Artificial Sequence
  Chemically Synthesized
  misc_feature (1)..(30): n is a, c, g, u, or other and this region may encompass 17-30 nucleotides
nnnnnnnnnnnnnnnnnnnnnnnnnnnnnnguuuaaguacucugugcuggaaacagcacagaaucuacuuaaacaaggcaaaaugccguguuuaucucgucaacuuguuggcgagauuuuuu

SEQ ID NO: 5527 - RNA, 116 nt, Artificial Sequence
  Chemically Synthesized
  misc_feature (1)..(30): n is a, c, g, u, or other and this region may encompass 17-30 nucleotides
nnnnnnnnnnnnnnnnnnnnnnnnnnnnnnguuuaaguacucugugcuggaaacagcacagaaucuacuuaaacaaggcaaaaugccguguuuaucucgucaacuuguuggcgaga

SEQ ID NO: 5528 - RNA, 124 nt, Artificial Sequence
  Chemically Synthesized
  misc_feature (1)..(30): n is a, c, g, u, or other and this region may encompass 17-30 nucleotides
  misc_feature (117)..(124): This region may encompass 1-8 uracil
nnnnnnnnnnnnnnnnnnnnnnnnnnnnnnguuuaaguacucugugcuggaaacagcacagaaucuacuuaaacaaggcaaaaugccguguuuaucucgucaacuuguuggcgagauuuuuuuu

SEQ ID NO: 5529 - RNA, 122 nt, Artificial Sequence
  Chemically Synthesized
  misc_feature (1)..(30): n is a, c, g, u, or other and this region may encompass 17-30 nucleotides
nnnnnnnnnnnnnnnnnnnnnnnnnnnnnnguuuuaguacucuguaaugaaaauuacagaaucuacuaaaacaaggcaaaaugccguguuuaucucgucaacuuguuggcgagauuuuuuuu

SEQ ID NO: 5530 - RNA, 114 nt, Artificial Sequence
  Chemically Synthesized
  misc_feature (1)..(30): n is a, c, g, u, or other and this region may encompass 17-30 nucleotides
nnnnnnnnnnnnnnnnnnnnnnnnnnnnnnguuuuaguacucuguaaugaaaauuacagaaucuacuaaaacaaggcaaaaugccguguuuaucucgucaacuuguuggcgaga

SEQ ID NO: 5531 - RNA, 122 nt, Artificial Sequence; identical to SEQ ID NO: 5529
  Chemically Synthesized
  misc_feature (1)..(30): n is a, c, g, u, or other and this region may encompass 17-30 nucleotides
  misc_feature (115)..(122): This region may encompass 1-8 uracil

SEQ ID NO: 5532 - RNA, 124 nt, Artificial Sequence; identical to SEQ ID NO: 5528
  Chemically Synthesized
  misc_feature (1)..(30): n is a, c, g, u, or other and this region may encompass 17-30 nucleotides

SEQ ID NO: 5533 - RNA, 116 nt, Artificial Sequence; identical to SEQ ID NO: 5527
  Chemically Synthesized
  misc_feature (1)..(30): n is a, c, g, u, or other and this region may encompass 17-30 nucleotides

SEQ ID NO: 5534 - RNA, 124 nt, Artificial Sequence; identical to SEQ ID NO: 5528
  Chemically Synthesized
  misc_feature (1)..(30): n is a, c, g, u, or other and this region may encompass 17-30 nucleotides
  misc_feature (117)..(124): This region may encompass 1-8 uracil

SEQ ID NO: 5535 - RNA, 110 nt, Artificial Sequence
  Chemically Synthesized
  misc_feature (1)..(30): n is a, c, g, u, or other and this region may encompass 17-30 nucleotides
nnnnnnnnnnnnnnnnnnnnnnnnnnnnnnguuuuaguacucuggaaacagaaucuacuaaaacaaggcaaaaugccguguuuaucucgucaacuuguuggcgagauuuu

SEQ ID NO: 5536 - RNA, 106 nt, Artificial Sequence
  Chemically Synthesized
  misc_feature (1)..(30): n is a, c, g, u, or other and this region may encompass 17-30 nucleotides
nnnnnnnnnnnnnnnnnnnnnnnnnnnnnnguuuuaguacucuggaaacagaaucuacuaaaacaaggcaaaaugccguguuuaucucgucaacuuguuggcgaga

SEQ ID NO: 5537 - RNA, 114 nt, Artificial Sequence
  Chemically Synthesized
  misc_feature (1)..(30): n is a, c, g, u, or other and this region may encompass 17-30 nucleotides
  misc_feature (96)..(114): This region may encompass 1-8 uracil
nnnnnnnnnnnnnnnnnnnnnnnnnnnnnnguuuuaguacucuggaaacagaaucuacuaaaacaaggcaaaaugccguguuuaucucgucaacuuguuggcgagauuuuuuuu

SEQ ID NO: 5538 - DNA, 6421 bp, Artificial Sequence
  Plasmid
  misc_feature (395)..(414): n is a, c, g, t, or other
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgnnnnnnnnnnnnnnnnnnnngttttagagctagaaatagcaagttaaaataaggctagtccgttatcaacttgaaaaagtggcaccgagtcggtgcttttttgctagtcgacaacgccagtaagtgacagagtcacaaatgactgcacagagtccttggtgaacaggcgaccatgcttttcagctctggaagtcgtgaaaacatacgttcccaaagagttttgaactgaaaacttcaccttccatgcagatatatgcacactttctgagaaggagagacaaatcaagaaacaaactgcacttgttgagcttgtgaaacacaagcccaaggcaacaaaagagcaactgaaagctgtttgagatgatttcgcagcttttgtagagaagtgctgcaaggctgacgataaggagacctgctttgccgaggagggtaaaaaacttgttgctgcaagtcaagctgccttaggcttataacatctacatttaaaagactctcagcctacctgaagaataagagaaagaaatgaaagatcaaaagcttattcatctgttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttctgtgggctaattaaataaatcactaatactcttctaagttaagtttgcagaagtttccaagttagtgacagatcttaccaaagtccacacggaatgctgcctgagagatctgcttgaatgtgctgatgacagggcggaccttgccaagtatatctgtgaaaatcaggattcgatctccagtaaactgaaggaatgctgtgaaaaacctctgttggaaaaatcccactgcattgccgaagtggaaaatgatgagtgacctgctgacttgccttacttagctgctgattttgttgaaagtaaggtgatttgcaaaaacttgactgaggcaaaggatgtcttcctgggctgatttttgtatgaatatgcaagaaggactcctgattactctgtcgtgctgctgctgagacttgccaagaactatgaaaccacagatctgaagtgctgtgccgctgcagatcctactgaatgctatgccaaagtgttcgatgaatttaaacctcttgtggaagagcctcagaatttaatcaaacaaaactgtgagctttttgagcagcttggagagtacaaattccagaatgcgctattagttcgttacaccaagaaagtaccccaagtgtcaactccaactcttgtagaggtctcaagaaacctcggaaaagtgggcagcaaatgttgtaaacatcctgaagcaaaaagatgaccctgtgcagaagactatctatccgtggtcctgaaccagttatgtgtgttgcatgaggatgtcttctggcaatttcatataagtattttttcaaaatgatctcttctgtcaaccccacgcctttggcacatgaaagtgggtaacctttatttcccttctttttctctttagctcggcttattccaggggtgtgtttcgtcgagatgcacacaagagtgaggttgctactcggtttaaagatttgggagaagaaaatttcaaagccttggtgttgattgcctttgctcagtatcttcagcagtgtccatttgaagatactgtaaaattagtgaatgaagtaactgaatttgcaaaaaactgtgtagctgtgaagtcagctgaaaattgtgacaaatcacttcataccctttttggagacaaattatgcacagttgcaactcttcgtgaaaccttgagtgaatgagctgactgctgtgcaaaacaagaacctgagagatgaaaatgcttcttgcaacacaaagtgaacaacccaaacctcccccgattggtcagaccagaggttgatgtgtgatgcactgcttttactgacaatgaagagacatttttgaaaaaatacttattgaaaattgccagaagaactccttactttttgaccccggaactccttttctttgctaaaaggtataaagctgcttttacagaatgttgccaagctgctgataaagctgcctgcctgttgccaaagctcgtgaaacttcgggtgaaagggaaggcttcgtctgccaaacagagactctgaaatgccagtctccaaaaatttggagaaagagctttcaaagcatgggcagtggctcgcctgagccagagatttcccaaagctgagggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttagcctggtgctgtgtcagccccggctagctaactaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagtctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5539 - DNA, 6421 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgttaaagatgatctcttacctgttttagagctagaaatagcaagttaaaataaggctagtccgttatcaacttgaaaaagtggcaccgagtcggtgcttttttgctagtcgacaacgccagtaagtgacagagtcacaaatgactgcacagagtccttggtgaacaggcgaccatgcttttcagctctggaagtcgtgaaaacatacgttcccaaagagttttgaactgaaaacttcaccttccatgcagatatatgcacactttctgagaaggagagacaaatcaagaaacaaactgcacttgttgagcttgtgaaacacaagcccaaggcaacaaaagagcaactgaaagctgtttgagatgatttcgcagcttttgtagagaagtgctgcaaggctgacgataaggagacctgctttgccgaggagggtaaaaaacttgttgctgcaagtcaagctgccttaggcttataacatctacatttaaaagactctcagcctacctgaagaataagagaaagaaatgaaagatcaaaagcttattcatctgttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttctgtgggctaattaaataaatcactaatactcttctaagttaagtttgcagaagtttccaagttagtgacagatcttaccaaagtccacacggaatgctgcctgagagatctgcttgaatgtgctgatgacagggcggaccttgccaagtatatctgtgaaaatcaggattcgatctccagtaaactgaaggaatgctgtgaaaaacctctgttggaaaaatcccactgcattgccgaagtggaaaatgatgagtgacctgctgacttgccttacttagctgctgattttgttgaaagtaaggtgatttgcaaaaacttgactgaggcaaaggatgtcttcctgggctgatttttgtatgaatatgcaagaaggactcctgattactctgtcgtgctgctgctgagacttgccaagaactatgaaaccacagatctgaagtgctgtgccgctgcagatcctactgaatgctatgccaaagtgttcgatgaatttaaacctcttgtggaagagcctcagaatttaatcaaacaaaactgtgagctttttgagcagcttggagagtacaaattccagaatgcgctattagttcgttacaccaagaaagtaccccaagtgtcaactccaactcttgtagaggtctcaagaaacctcggaaaagtgggcagcaaatgttgtaaacatcctgaagcaaaaagatgaccctgtgcagaagactatctatccgtggtcctgaaccagttatgtgtgttgcatgaggatgtcttctggcaatttcatataagtattttttcaaaatgatctcttctgtcaaccccacgcctttggcacatgaaagtgggtaacctttatttcccttctttttctctttagctcggcttattccaggggtgtgtttcgtcgagatgcacacaagagtgaggttgctactcggtttaaagatttgggagaagaaaatttcaaagccttggtgttgattgcctttgctcagtatcttcagcagtgtccatttgaagatactgtaaaattagtgaatgaagtaactgaatttgcaaaaaactgtgtagctgtgaagtcagctgaaaattgtgacaaatcacttcataccctttttggagacaaattatgcacagttgcaactcttcgtgaaaccttgagtgaatgagctgactgctgtgcaaaacaagaacctgagagatgaaaatgcttcttgcaacacaaagtgaacaacccaaacctcccccgattggtcagaccagaggttgatgtgtgatgcactgcttttactgacaatgaagagacatttttgaaaaaatacttattgaaaattgccagaagaactccttactttttgaccccggaactccttttctttgctaaaaggtataaagctgcttttacagaatgttgccaagctgctgataaagctgcctgcctgttgccaaagctcgtgaaacttcgggtgaaagggaaggcttcgtctgccaaacagagactctgaaatgccagtctccaaaaatttggagaaagagctttcaaagcatgggcagtggctcgcctgagccagagatttcccaaagctgagggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttagcctggtgctgtgtcagccccggctagctaactaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagtctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5540 - DNA, 6421 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgctcttaccttgggaaaggaggttttagagctagaaatagcaagttaaaataaggctagtccgttatcaacttgaaaaagtggcaccgagtcggtgcttttttgctagtcgacaacgccagtaagtgacagagtcacaaatgactgcacagagtccttggtgaacaggcgaccatgcttttcagctctggaagtcgtgaaaacatacgttcccaaagagttttgaactgaaaacttcaccttccatgcagatatatgcacactttctgagaaggagagacaaatcaagaaacaaactgcacttgttgagcttgtgaaacacaagcccaaggcaacaaaagagcaactgaaagctgtttgagatgatttcgcagcttttgtagagaagtgctgcaaggctgacgataaggagacctgctttgccgaggagggtaaaaaacttgttgctgcaagtcaagctgccttaggcttataacatctacatttaaaagactctcagcctacctgaagaataagagaaagaaatgaaagatcaaaagcttattcatctgttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttctgtgggctaattaaataaatcactaatactcttctaagttaagtttgcagaagtttccaagttagtgacagatcttaccaaagtccacacggaatgctgcctgagagatctgcttgaatgtgctgatgacagggcggaccttgccaagtatatctgtgaaaatcaggattcgatctccagtaaactgaaggaatgctgtgaaaaacctctgttggaaaaatcccactgcattgccgaagtggaaaatgatgagtgacctgctgacttgccttacttagctgctgattttgttgaaagtaaggtgatttgcaaaaacttgactgaggcaaaggatgtcttcctgggctgatttttgtatgaatatgcaagaaggactcctgattactctgtcgtgctgctgctgagacttgccaagaactatgaaaccacagatctgaagtgctgtgccgctgcagatcctactgaatgctatgccaaagtgttcgatgaatttaaacctcttgtggaagagcctcagaatttaatcaaacaaaactgtgagctttttgagcagcttggagagtacaaattccagaatgcgctattagttcgttacaccaagaaagtaccccaagtgtcaactccaactcttgtagaggtctcaagaaacctcggaaaagtgggcagcaaatgttgtaaacatcctgaagcaaaaagatgaccctgtgcagaagactatctatccgtggtcctgaaccagttatgtgtgttgcatgaggatgtcttctggcaatttcatataagtattttttcaaaatgatctcttctgtcaaccccacgcctttggcacatgaaagtgggtaacctttatttcccttctttttctctttagctcggcttattccaggggtgtgtttcgtcgagatgcacacaagagtgaggttgctactcggtttaaagatttgggagaagaaaatttcaaagccttggtgttgattgcctttgctcagtatcttcagcagtgtccatttgaagatactgtaaaattagtgaatgaagtaactgaatttgcaaaaaactgtgtagctgtgaagtcagctgaaaattgtgacaaatcacttcataccctttttggagacaaattatgcacagttgcaactcttcgtgaaaccttgagtgaatgagctgactgctgtgcaaaacaagaacctgagagatgaaaatgcttcttgcaacacaaagtgaacaacccaaacctcccccgattggtcagaccagaggttgatgtgtgatgcactgcttttactgacaatgaagagacatttttgaaaaaatacttattgaaaattgccagaagaactccttactttttgaccccggaactccttttctttgctaaaaggtataaagctgcttttacagaatgttgccaagctgctgataaagctgcctgcctgttgccaaagctcgtgaaacttcgggtgaaagggaaggcttcgtctgccaaacagagactctgaaatgccagtctccaaaaatttggagaaagagctttcaaagcatgggcagtggctcgcctgagccagagatttcccaaagctgagggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttagcctggtgctgtgtcagccccggctagctaactaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagtctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5541 - DNA, 6421 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgatgatctcttaccttgggaagttttagagctagaaatagcaagttaaaataaggctagtccgttatcaacttgaaaaagtggcaccgagtcggtgcttttttgctagtcgacaacgccagtaagtgacagagtcacaaatgactgcacagagtccttggtgaacaggcgaccatgcttttcagctctggaagtcgtgaaaacatacgttcccaaagagttttgaactgaaaacttcaccttccatgcagatatatgcacactttctgagaaggagagacaaatcaagaaacaaactgcacttgttgagcttgtgaaacacaagcccaaggcaacaaaagagcaactgaaagctgtttgagatgatttcgcagcttttgtagagaagtgctgcaaggctgacgataaggagacctgctttgccgaggagggtaaaaaacttgttgctgcaagtcaagctgccttaggcttataacatctacatttaaaagactctcagcctacctgaagaataagagaaagaaatgaaagatcaaaagcttattcatctgttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttctgtgggctaattaaataaatcactaatactcttctaagttaagtttgcagaagtttccaagttagtgacagatcttaccaaagtccacacggaatgctgcctgagagatctgcttgaatgtgctgatgacagggcggaccttgccaagtatatctgtgaaaatcaggattcgatctccagtaaactgaaggaatgctgtgaaaaacctctgttggaaaaatcccactgcattgccgaagtggaaaatgatgagtgacctgctgacttgccttacttagctgctgattttgttgaaagtaaggtgatttgcaaaaacttgactgaggcaaaggatgtcttcctgggctgatttttgtatgaatatgcaagaaggactcctgattactctgtcgtgctgctgctgagacttgccaagaactatgaaaccacagatctgaagtgctgtgccgctgcagatcctactgaatgctatgccaaagtgttcgatgaatttaaacctcttgtggaagagcctcagaatttaatcaaacaaaactgtgagctttttgagcagcttggagagtacaaattccagaatgcgctattagttcgttacaccaagaaagtaccccaagtgtcaactccaactcttgtagaggtctcaagaaacctcggaaaagtgggcagcaaatgttgtaaacatcctgaagcaaaaagatgaccctgtgcagaagactatctatccgtggtcctgaaccagttatgtgtgttgcatgaggatgtcttctggcaatttcatataagtattttttcaaaatgatctcttctgtcaaccccacgcctttggcacatgaaagtgggtaacctttatttcccttctttttctctttagctcggcttattccaggggtgtgtttcgtcgagatgcacacaagagtgaggttgctactcggtttaaagatttgggagaagaaaatttcaaagccttggtgttgattgcctttgctcagtatcttcagcagtgtccatttgaagatactgtaaaattagtgaatgaagtaactgaatttgcaaaaaactgtgtagctgtgaagtcagctgaaaattgtgacaaatcacttcataccctttttggagacaaattatgcacagttgcaactcttcgtgaaaccttgagtgaatgagctgactgctgtgcaaaacaagaacctgagagatgaaaatgcttcttgcaacacaaagtgaacaacccaaacctcccccgattggtcagaccagaggttgatgtgtgatgcactgcttttactgacaatgaagagacatttttgaaaaaatacttattgaaaattgccagaagaactccttactttttgaccccggaactccttttctttgctaaaaggtataaagctgcttttacagaatgttgccaagctgctgataaagctgcctgcctgttgccaaagctcgtgaaacttcgggtgaaagggaaggcttcgtctgccaaacagagactctgaaatgccagtctccaaaaatttggagaaagagctttcaaagcatgggcagtggctcgcctgagccagagatttcccaaagctgagggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttagcctggtgctgtgtcagccccggctagctaactaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagtctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5542 - DNA, 6421 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtaaagatgatctcttaccttgttttagagctagaaatagcaagttaaaataaggctagtccgttatcaacttgaaaaagtggcaccgagtcggtgcttttttgctagtcgacaacgccagtaagtgacagagtcacaaatgactgcacagagtccttggtgaacaggcgaccatgcttttcagctctggaagtcgtgaaaacatacgttcccaaagagttttgaactgaaaacttcaccttccatgcagatatatgcacactttctgagaaggagagacaaatcaagaaacaaactgcacttgttgagcttgtgaaacacaagcccaaggcaacaaaagagcaactgaaagctgtttgagatgatttcgcagcttttgtagagaagtgctgcaaggctgacgataaggagacctgctttgccgaggagggtaaaaaacttgttgctgcaagtcaagctgccttaggcttataacatctacatttaaaagactctcagcctacctgaagaataagagaaagaaatgaaagatcaaaagcttattcatctgttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttctgtgggctaattaaataaatcactaatactcttctaagttaagtttgcagaagtttccaagttagtgacagatcttaccaaagtccacacggaatgctgcctgagagatctgcttgaatgtgctgatgacagggcggaccttgccaagtatatctgtgaaaatcaggattcgatctccagtaaactgaaggaatgctgtgaaaaacctctgttggaaaaatcccactgcattgccgaagtggaaaatgatgagtgacctgctgacttgccttacttagctgctgattttgttgaaagtaaggtgatttgcaaaaacttgactgaggcaaaggatgtcttcctgggctgatttttgtatgaatatgcaagaaggactcctgattactctgtcgtgctgctgctgagacttgccaagaactatgaaaccacagatctgaagtgctgtgccgctgcagatcctactgaatgctatgccaaagtgttcgatgaatttaaacctcttgtggaagagcctcagaatttaatcaaacaaaactgtgagctttttgagcagcttggagagtacaaattccagaatgcgctattagttcgttacaccaagaaagtaccccaagtgtcaactccaactcttgtagaggtctcaagaaacctcggaaaagtgggcagcaaatgttgtaaacatcctgaagcaaaaagatgaccctgtgcagaagactatctatccgtggtcctgaaccagttatgtgtgttgcatgaggatgtcttctggcaatttcatataagtattttttcaaaatgatctcttctgtcaaccccacgcctttggcacatgaaagtgggtaacctttatttcccttctttttctctttagctcggcttattccaggggtgtgtttcgtcgagatgcacacaagagtgaggttgctactcggtttaaagatttgggagaagaaaatttcaaagccttggtgttgattgcctttgctcagtatcttcagcagtgtccatttgaagatactgtaaaattagtgaatgaagtaactgaatttgcaaaaaactgtgtagctgtgaagtcagctgaaaattgtgacaaatcacttcataccctttttggagacaaattatgcacagttgcaactcttcgtgaaaccttgagtgaatgagctgactgctgtgcaaaacaagaacctgagagatgaaaatgcttcttgcaacacaaagtgaacaacccaaacctcccccgattggtcagaccagaggttgatgtgtgatgcactgcttttactgacaatgaagagacatttttgaaaaaatacttattgaaaattgccagaagaactccttactttttgaccccggaactccttttctttgctaaaaggtataaagctgcttttacagaatgttgccaagctgctgataaagctgcctgcctgttgccaaagctcgtgaaacttcgggtgaaagggaaggcttcgtctgccaaacagagactctgaaatgccagtctccaaaaatttggagaaagagctttcaaagcatgggcagtggctcgcctgagccagagatttcccaaagctgagggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttagcctggtgctgtgtcagccccggctagctaactaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagtctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5543 - DNA, 6421 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtgaacacctctcctttcccagttttagagctagaaatagcaagttaaaataaggctagtccgttatcaacttgaaaaagtggcaccgagtcggtgcttttttgctagtcgacaacgccagtaagtgacagagtcacaaatgactgcacagagtccttggtgaacaggcgaccatgcttttcagctctggaagtcgtgaaaacatacgttcccaaagagttttgaactgaaaacttcaccttccatgcagatatatgcacactttctgagaaggagagacaaatcaagaaacaaactgcacttgttgagcttgtgaaacacaagcccaaggcaacaaaagagcaactgaaagctgtttgagatgatttcgcagcttttgtagagaagtgctgcaaggctgacgataaggagacctgctttgccgaggagggtaaaaaacttgttgctgcaagtcaagctgccttaggcttataacatctacatttaaaagactctcagcctacctgaagaataagagaaagaaatgaaagatcaaaagcttattcatctgttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttctgtgggctaattaaataaatcactaatactcttctaagttaagtttgcagaagtttccaagttagtgacagatcttaccaaagtccacacggaatgctgcctgagagatctgcttgaatgtgctgatgacagggcggaccttgccaagtatatctgtgaaaatcaggattcgatctccagtaaactgaaggaatgctgtgaaaaacctctgttggaaaaatcccactgcattgccgaagtggaaaatgatgagtgacctgctgacttgccttacttagctgctgattttgttgaaagtaaggtgatttgcaaaaacttgactgaggcaaaggatgtcttcctgggctgatttttgtatgaatatgcaagaaggactcctgattactctgtcgtgctgctgctgagacttgccaagaactatgaaaccacagatctgaagtgctgtgccgctgcagatcctactgaatgctatgccaaagtgttcgatgaatttaaacctcttgtggaagagcctcagaatttaatcaaacaaaactgtgagctttttgagcagcttggagagtacaaattccagaatgcgctattagttcgttacaccaagaaagtaccccaagtgtcaactccaactcttgtagaggtctcaagaaacctcggaaaagtgggcagcaaatgttgtaaacatcctgaagcaaaaagatgaccctgtgcagaagactatctatccgtggtcctgaaccagttatgtgtgttgcatgaggatgtcttctggcaatttcatataagtattttttcaaaatgatctcttctgtcaaccccacgcctttggcacatgaaagtgggtaacctttatttcccttctttttctctttagctcggcttattccaggggtgtgtttcgtcgagatgcacacaagagtgaggttgctactcggtttaaagatttgggagaagaaaatttcaaagccttggtgttgattgcctttgctcagtatcttcagcagtgtccatttgaagatactgtaaaattagtgaatgaagtaactgaatttgcaaaaaactgtgtagctgtgaagtcagctgaaaattgtgacaaatcacttcataccctttttggagacaaattatgcacagttgcaactcttcgtgaaaccttgagtgaatgagctgactgctgtgcaaaacaagaacctgagagatgaaaatgcttcttgcaacacaaagtgaacaacccaaacctcccccgattggtcagaccagaggttgatgtgtgatgcactgcttttactgacaatgaagagacatttttgaaaaaatacttattgaaaattgccagaagaactccttactttttgaccccggaactccttttctttgctaaaaggtataaagctgcttttacagaatgttgccaagctgctgataaagctgcctgcctgttgccaaagctcgtgaaacttcgggtgaaagggaaggcttcgtctgccaaacagagactctgaaatgccagtctccaaaaatttggagaaagagctttcaaagcatgggcagtggctcgcctgagccagagatttcccaaagctgagggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttagcctggtgctgtgtcagccccggctagctaactaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagtctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5544 - DNA, 6421 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtcaactggcctgcaactgcagttttagagctagaaatagcaagttaaaataaggctagtccgttatcaacttgaaaaagtggcaccgagtcggtgcttttttgctagtcgacaacgccagtaagtgacagagtcacaaatgactgcacagagtccttggtgaacaggcgaccatgcttttcagctctggaagtcgtgaaaacatacgttcccaaagagttttgaactgaaaacttcaccttccatgcagatatatgcacactttctgagaaggagagacaaatcaagaaacaaactgcacttgttgagcttgtgaaacacaagcccaaggcaacaaaagagcaactgaaagctgtttgagatgatttcgcagcttttgtagagaagtgctgcaaggctgacgataaggagacctgctttgccgaggagggtaaaaaacttgttgctgcaagtcaagctgccttaggcttataacatctacatttaaaagactctcagcctacctgaagaataagagaaagaaatgaaagatcaaaagcttattcatctgttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttctgtgggctaattaaataaatcactaatactcttctaagttaagtttgcagaagtttccaagttagtgacagatcttaccaaagtccacacggaatgctgcctgagagatctgcttgaatgtgctgatgacagggcggaccttgccaagtatatctgtgaaaatcaggattcgatctccagtaaactgaaggaatgctgtgaaaaacctctgttggaaaaatcccactgcattgccgaagtggaaaatgatgagtgacctgctgacttgccttacttagctgctgattttgttgaaagtaaggtgatttgcaaaaacttgactgaggcaaaggatgtcttcctgggctgatttttgtatgaatatgcaagaaggactcctgattactctgtcgtgctgctgctgagacttgccaagaactatgaaaccacagatctgaagtgctgtgccgctgcagatcctactgaatgctatgccaaagtgttcgatgaatttaaacctcttgtggaagagcctcagaatttaatcaaacaaaactgtgagctttttgagcagcttggagagtacaaattccagaatgcgctattagttcgttacaccaagaaagtaccccaagtgtcaactccaactcttgtagaggtctcaagaaacctcggaaaagtgggcagcaaatgttgtaaacatcctgaagcaaaaagatgaccctgtgcagaagactatctatccgtggtcctgaaccagttatgtgtgttgcatgaggatgtcttctggcaatttcatataagtattttttcaaaatgatctcttctgtcaaccccacgcctttggcacatgaaagtgggtaacctttatttcccttctttttctctttagctcggcttattccaggggtgtgtttcgtcgagatgcacacaagagtgaggttgctactcggtttaaagatttgggagaagaaaatttcaaagccttggtgttgattgcctttgctcagtatcttcagcagtgtccatttgaagatactgtaaaattagtgaatgaagtaactgaatttgcaaaaaactgtgtagctgtgaagtcagctgaaaattgtgacaaatcacttcataccctttttggagacaaattatgcacagttgcaactcttcgtgaaaccttgagtgaatgagctgactgctgtgcaaaacaagaacctgagagatgaaaatgcttcttgcaacacaaagtgaacaacccaaacctcccccgattggtcagaccagaggttgatgtgtgatgcactgcttttactgacaatgaagagacatttttgaaaaaatacttattgaaaattgccagaagaactccttactttttgaccccggaactccttttctttgctaaaaggtataaagctgcttttacagaatgttgccaagctgctgataaagctgcctgcctgttgccaaagctcgtgaaacttcgggtgaaagggaaggcttcgtctgccaaacagagactctgaaatgccagtctccaaaaatttggagaaagagctttcaaagcatgggcagtggctcgcctgagccagagatttcccaaagctgagggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttagcctggtgctgtgtcagccccggctagctaactaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagtctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5545 - DNA, 6421 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccggcatatgatgatagtattatgttttagagctagaaatagcaagttaaaataaggctagtccgttatcaacttgaaaaagtggcaccgagtcggtgcttttttgctagtcgacaacgccagtaagtgacagagtcacaaatgactgcacagagtccttggtgaacaggcgaccatgcttttcagctctggaagtcgtgaaaacatacgttcccaaagagttttgaactgaaaacttcaccttccatgcagatatatgcacactttctgagaaggagagacaaatcaagaaacaaactgcacttgttgagcttgtgaaacacaagcccaaggcaacaaaagagcaactgaaagctgtttgagatgatttcgcagcttttgtagagaagtgctgcaaggctgacgataaggagacctgctttgccgaggagggtaaaaaacttgttgctgcaagtcaagctgccttaggcttataacatctacatttaaaagactctcagcctacctgaagaataagagaaagaaatgaaagatcaaaagcttattcatctgttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttctgtgggctaattaaataaatcactaatactcttctaagttaagtttgcagaagtttccaagttagtgacagatcttaccaaagtccacacggaatgctgcctgagagatctgcttgaatgtgctgatgacagggcggaccttgccaagtatatctgtgaaaatcaggattcgatctccagtaaactgaaggaatgctgtgaaaaacctctgttggaaaaatcccactgcattgccgaagtggaaaatgatgagtgacctgctgacttgccttacttagctgctgattttgttgaaagtaaggtgatttgcaaaaacttgactgaggcaaaggatgtcttcctgggctgatttttgtatgaatatgcaagaaggactcctgattactctgtcgtgctgctgctgagacttgccaagaactatgaaaccacagatctgaagtgctgtgccgctgcagatcctactgaatgctatgccaaagtgttcgatgaatttaaacctcttgtggaagagcctcagaatttaatcaaacaaaactgtgagctttttgagcagcttggagagtacaaattccagaatgcgctattagttcgttacaccaagaaagtaccccaagtgtcaactccaactcttgtagaggtctcaagaaacctcggaaaagtgggcagcaaatgttgtaaacatcctgaagcaaaaagatgaccctgtgcagaagactatctatccgtggtcctgaaccagttatgtgtgttgcatgaggatgtcttctggcaatttcatataagtattttttcaaaatgatctcttctgtcaaccccacgcctttggcacatgaaagtgggtaacctttatttcccttctttttctctttagctcggcttattccaggggtgtgtttcgtcgagatgcacacaagagtgaggttgctactcggtttaaagatttgggagaagaaaatttcaaagccttggtgttgattgcctttgctcagtatcttcagcagtgtccatttgaagatactgtaaaattagtgaatgaagtaactgaatttgcaaaaaactgtgtagctgtgaagtcagctgaaaattgtgacaaatcacttcataccctttttggagacaaattatgcacagttgcaactcttcgtgaaaccttgagtgaatgagctgactgctgtgcaaaacaagaacctgagagatgaaaatgcttcttgcaacacaaagtgaacaacccaaacctcccccgattggtcagaccagaggttgatgtgtgatgcactgcttttactgacaatgaagagacatttttgaaaaaatacttattgaaaattgccagaagaactccttactttttgaccccggaactccttttctttgctaaaaggtataaagctgcttttacagaatgttgccaagctgctgataaagctgcctgcctgttgccaaagctcgtgaaacttcgggtgaaagggaaggcttcgtctgccaaacagagactctgaaatgccagtctccaaaaatttggagaaagagctttcaaagcatgggcagtggctcgcctgagccagagatttcccaaagctgagggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttagcctggtgctgtgtcagccccggctagctaactaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagtctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5546 - DNA, 6421 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtttaacacttccctagccaagttttagagctagaaatagcaagttaaaataaggctagtccgttatcaacttgaaaaagtggcaccgagtcggtgcttttttgctagtcgacaacgccagtaagtgacagagtcacaaatgactgcacagagtccttggtgaacaggcgaccatgcttttcagctctggaagtcgtgaaaacatacgttcccaaagagttttgaactgaaaacttcaccttccatgcagatatatgcacactttctgagaaggagagacaaatcaagaaacaaactgcacttgttgagcttgtgaaacacaagcccaaggcaacaaaagagcaactgaaagctgtttgagatgatttcgcagcttttgtagagaagtgctgcaaggctgacgataaggagacctgctttgccgaggagggtaaaaaacttgttgctgcaagtcaagctgccttaggcttataacatctacatttaaaagactctcagcctacctgaagaataagagaaagaaatgaaagatcaaaagcttattcatctgttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttctgtgggctaattaaataaatcactaatactcttctaagttaagtttgcagaagtttccaagttagtgacagatcttaccaaagtccacacggaatgctgcctgagagatctgcttgaatgtgctgatgacagggcggaccttgccaagtatatctgtgaaaatcaggattcgatctccagtaaactgaaggaatgctgtgaaaaacctctgttggaaaaatcccactgcattgccgaagtggaaaatgatgagtgacctgctgacttgccttacttagctgctgattttgttgaaagtaaggtgatttgcaaaaacttgactgaggcaaaggatgtcttcctgggctgatttttgtatgaatatgcaagaaggactcctgattactctgtcgtgctgctgctgagacttgccaagaactatgaaaccacagatctgaagtgctgtgccgctgcagatcctactgaatgctatgccaaagtgttcgatgaatttaaacctcttgtggaagagcctcagaatttaatcaaacaaaactgtgagctttttgagcagcttggagagtacaaattccagaatgcgctattagttcgttacaccaagaaagtaccccaagtgtcaactccaactcttgtagaggtctcaagaaacctcggaaaagtgggcagcaaatgttgtaaacatcctgaagcaaaaagatgaccctgtgcagaagactatctatccgtggtcctgaaccagttatgtgtgttgcatgaggatgtcttctggcaatttcatataagtattttttcaaaatgatctcttctgtcaaccccacgcctttggcacatgaaagtgggtaacctttatttcccttctttttctctttagctcggcttattccaggggtgtgtttcgtcgagatgcacacaagagtgaggttgctactcggtttaaagatttgggagaagaaaatttcaaagccttggtgttgattgcctttgctcagtatcttcagcagtgtccatttgaagatactgtaaaattagtgaatgaagtaactgaatttgcaaaaaactgtgtagctgtgaagtcagctgaaaattgtgacaaatcacttcataccctttttggagacaaattatgcacagttgcaactcttcgtgaaaccttgagtgaatgagctgactgctgtgcaaaacaagaacctgagagatgaaaatgcttcttgcaacacaaagtgaacaacccaaacctcccccgattggtcagaccagaggttgatgtgtgatgcactgcttttactgacaatgaagagacatttttgaaaaaatacttattgaaaattgccagaagaactccttactttttgaccccggaactccttttctttgctaaaaggtataaagctgcttttacagaatgttgccaagctgctgataaagctgcctgcctgttgccaaagctcgtgaaacttcgggtgaaagggaaggcttcgtctgccaaacagagactctgaaatgccagtctccaaaaatttggagaaagagctttcaaagcatgggcagtggctcgcctgagccagagatttcccaaagctgagggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttagcctggtgctgtgtcagccccggctagctaactaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagtctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5547 - DNA, 6421 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgttaattagctcctttggctagttttagagctagaaatagcaagttaaaataaggctagtccgttatcaacttgaaaaagtggcaccgagtcggtgcttttttgctagtcgacaacgccagtaagtgacagagtcacaaatgactgcacagagtccttggtgaacaggcgaccatgcttttcagctctggaagtcgtgaaaacatacgttcccaaagagttttgaactgaaaacttcaccttccatgcagatatatgcacactttctgagaaggagagacaaatcaagaaacaaactgcacttgttgagcttgtgaaacacaagcccaaggcaacaaaagagcaactgaaagctgtttgagatgatttcgcagcttttgtagagaagtgctgcaaggctgacgataaggagacctgctttgccgaggagggtaaaaaacttgttgctgcaagtcaagctgccttaggcttataacatctacatttaaaagactctcagcctacctgaagaataagagaaagaaatgaaagatcaaaagcttattcatctgttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttctgtgggctaattaaataaatcactaatactcttctaagttaagtttgcagaagtttccaagttagtgacagatcttaccaaagtccacacggaatgctgcctgagagatctgcttgaatgtgctgatgacagggcggaccttgccaagtatatctgtgaaaatcaggattcgatctccagtaaactgaaggaatgctgtgaaaaacctctgttggaaaaatcccactgcattgccgaagtggaaaatgatgagtgacctgctgacttgccttacttagctgctgattttgttgaaagtaaggtgatttgcaaaaacttgactgaggcaaaggatgtcttcctgggctgatttttgtatgaatatgcaagaaggactcctgattactctgtcgtgctgctgctgagacttgccaagaactatgaaaccacagatctgaagtgctgtgccgctgcagatcctactgaatgctatgccaaagtgttcgatgaatttaaacctcttgtggaagagcctcagaatttaatcaaacaaaactgtgagctttttgagcagcttggagagtacaaattccagaatgcgctattagttcgttacaccaagaaagtaccccaagtgtcaactccaactcttgtagaggtctcaagaaacctcggaaaagtgggcagcaaatgttgtaaacatcctgaagcaaaaagatgaccctgtgcagaagactatctatccgtggtcctgaaccagttatgtgtgttgcatgaggatgtcttctggcaatttcatataagtattttttcaaaatgatctcttctgtcaaccccacgcctttggcacatgaaagtgggtaacctttatttcccttctttttctctttagctcggcttattccaggggtgtgtttcgtcgagatgcacacaagagtgaggttgctactcggtttaaagatttgggagaagaaaatttcaaagccttggtgttgattgcctttgctcagtatcttcagcagtgtccatttgaagatactgtaaaattagtgaatgaagtaactgaatttgcaaaaaactgtgtagctgtgaagtcagctgaaaattgtgacaaatcacttcataccctttttggagacaaattatgcacagttgcaactcttcgtgaaaccttgagtgaatgagctgactgctgtgcaaaacaagaacctgagagatgaaaatgcttcttgcaacacaaagtgaacaacccaaacctcccccgattggtcagaccagaggttgatgtgtgatgcactgcttttactgacaatgaagagacatttttgaaaaaatacttattgaaaattgccagaagaactccttactttttgaccccggaactccttttctttgctaaaaggtataaagctgcttttacagaatgttgccaagctgctgataaagctgcctgcctgttgccaaagctcgtgaaacttcgggtgaaagggaaggcttcgtctgccaaacagagactctgaaatgccagtctccaaaaatttggagaaagagctttcaaagcatgggcagtggctcgcctgagccagagatttcccaaagctgagggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttagcctggtgctgtgtcagccccggctagctaactaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagtctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5548 - DNA, 6421 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgaatgtatgctggcttttaaggttttagagctagaaatagcaagttaaaataaggctagtccgttatcaacttgaaaaagtggcaccgagtcggtgcttttttgctagtcgacaacgccagtaagtgacagagtcacaaatgactgcacagagtccttggtgaacaggcgaccatgcttttcagctctggaagtcgtgaaaacatacgttcccaaagagttttgaactgaaaacttcaccttccatgcagatatatgcacactttctgagaaggagagacaaatcaagaaacaaactgcacttgttgagcttgtgaaacacaagcccaaggcaacaaaagagcaactgaaagctgtttgagatgatttcgcagcttttgtagagaagtgctgcaaggctgacgataaggagacctgctttgccgaggagggtaaaaaacttgttgctgcaagtcaagctgccttaggcttataacatctacatttaaaagactctcagcctacctgaagaataagagaaagaaatgaaagatcaaaagcttattcatctgttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttctgtgggctaattaaataaatcactaatactcttctaagttaagtttgcagaagtttccaagttagtgacagatcttaccaaagtccacacggaatgctgcctgagagatctgcttgaatgtgctgatgacagggcggaccttgccaagtatatctgtgaaaatcaggattcgatctccagtaaactgaaggaatgctgtgaaaaacctctgttggaaaaatcccactgcattgccgaagtggaaaatgatgagtgacctgctgacttgccttacttagctgctgattttgttgaaagtaaggtgatttgcaaaaacttgactgaggcaaaggatgtcttcctgggctgatttttgtatgaatatgcaagaaggactcctgattactctgtcgtgctgctgctgagacttgccaagaactatgaaaccacagatctgaagtgctgtgccgctgcagatcctactgaatgctatgccaaagtgttcgatgaatttaaacctcttgtggaagagcctcagaatttaatcaaacaaaactgtgagctttttgagcagcttggagagtacaaattccagaatgcgctattagttcgttacaccaagaaagtaccccaagtgtcaactccaactcttgtagaggtctcaagaaacctcggaaaagtgggcagcaaatgttgtaaacatcctgaagcaaaaagatgaccctgtgcagaagactatctatccgtggtcctgaaccagttatgtgtgttgcatgaggatgtcttctggcaatttcatataagtattttttcaaaatgatctcttctgtcaaccccacgcctttggcacatgaaagtgggtaacctttatttcccttctttttctctttagctcggcttattccaggggtgtgtttcgtcgagatgcacacaagagtgaggttgctactcggtttaaagatttgggagaagaaaatttcaaagccttggtgttgattgcctttgctcagtatcttcagcagtgtccatttgaagatactgtaaaattagtgaatgaagtaactgaatttgcaaaaaactgtgtagctgtgaagtcagctgaaaattgtgacaaatcacttcataccctttttggagacaaattatgcacagttgcaactcttcgtgaaaccttgagtgaatgagctgactgctgtgcaaaacaagaacctgagagatgaaaatgcttcttgcaacacaaagtgaacaacccaaacctcccccgattggtcagaccagaggttgatgtgtgatgcactgcttttactgacaatgaagagacatttttgaaaaaatacttattgaaaattgccagaagaactccttactttttgaccccggaactccttttctttgctaaaaggtataaagctgcttttacagaatgttgccaagctgctgataaagctgcctgcctgttgccaaagctcgtgaaacttcgggtgaaagggaaggcttcgtctgccaaacagagactctgaaatgccagtctccaaaaatttggagaaagagctttcaaagcatgggcagtggctcgcctgagccagagatttcccaaagctgagggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttagcctggtgctgtgtcagccccggctagctaactaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagtctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5549 - DNA, 6421 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgaagagatcatctttaagaaagttttagagctagaaatagcaagttaaaataaggctagtccgttatcaacttgaaaaagtggcaccgagtcggtgcttttttgctagtcgacaacgccagtaagtgacagagtcacaaatgactgcacagagtccttggtgaacaggcgaccatgcttttcagctctggaagtcgtgaaaacatacgttcccaaagagttttgaactgaaaacttcaccttccatgcagatatatgcacactttctgagaaggagagacaaatcaagaaacaaactgcacttgttgagcttgtgaaacacaagcccaaggcaacaaaagagcaactgaaagctgtttgagatgatttcgcagcttttgtagagaagtgctgcaaggctgacgataaggagacctgctttgccgaggagggtaaaaaacttgttgctgcaagtcaagctgccttaggcttataacatctacatttaaaagactctcagcctacctgaagaataagagaaagaaatgaaagatcaaaagcttattcatctgttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttctgtgggctaattaaataaatcactaatactcttctaagttaagtttgcagaagtttccaagttagtgacagatcttaccaaagtccacacggaatgctgcctgagagatctgcttgaatgtgctgatgacagggcggaccttgccaagtatatctgtgaaaatcaggattcgatctccagtaaactgaaggaatgctgtgaaaaacctctgttggaaaaatcccactgcattgccgaagtggaaaatgatgagtgacctgctgacttgccttacttagctgctgattttgttgaaagtaaggtgatttgcaaaaacttgactgaggcaaaggatgtcttcctgggctgatttttgtatgaatatgcaagaaggactcctgattactctgtcgtgctgctgctgagacttgccaagaactatgaaaccacagatctgaagtgctgtgccgctgcagatcctactgaatgctatgccaaagtgttcgatgaatttaaacctcttgtggaagagcctcagaatttaatcaaacaaaactgtgagctttttgagcagcttggagagtacaaattccagaatgcgctattagttcgttacaccaagaaagtaccccaagtgtcaactccaactcttgtagaggtctcaagaaacctcggaaaagtgggcagcaaatgttgtaaacatcctgaagcaaaaagatgaccctgtgcagaagactatctatccgtggtcctgaaccagttatgtgtgttgcatgaggatgtcttctggcaatttcatataagtattttttcaaaatgatctcttctgtcaaccccacgcctttggcacatgaaagtgggtaacctttatttcccttctttttctctttagctcggcttattccaggggtgtgtttcgtcgagatgcacacaagagtgaggttgctactcggtttaaagatttgggagaagaaaatttcaaagccttggtgttgattgcctttgctcagtatcttcagcagtgtccatttgaagatactgtaaaattagtgaatgaagtaactgaatttgcaaaaaactgtgtagctgtgaagtcagctgaaaattgtgacaaatcacttcataccctttttggagacaaattatgcacagttgcaactcttcgtgaaaccttgagtgaatgagctgactgctgtgcaaaacaagaacctgagagatgaaaatgcttcttgcaacacaaagtgaacaacccaaacctcccccgattggtcagaccagaggttgatgtgtgatgcactgcttttactgacaatgaagagacatttttgaaaaaatacttattgaaaattgccagaagaactccttactttttgaccccggaactccttttctttgctaaaaggtataaagctgcttttacagaatgttgccaagctgctgataaagctgcctgcctgttgccaaagctcgtgaaacttcgggtgaaagggaaggcttcgtctgccaaacagagactctgaaatgccagtctccaaaaatttggagaaagagctttcaaagcatgggcagtggctcgcctgagccagagatttcccaaagctgagggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttagcctggtgctgtgtcagccccggctagctaactaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagtctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5550 - DNA, 6431 bp, Artificial Sequence
  Plasmid
  misc_feature (395)..(414): n is a, c, g, or t
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgnnnnnnnnnnnnnnnnnnnngtttaagtactctgtgctggaaacagcacagaatctacttaaacaaggcaaaatgccgtgtttatctcgtcaacttgttggcgagattttttgctagtcgacaacgccagtaagtgacagagtcacaaatgactgcacagagtccttggtgaacaggcgaccatgcttttcagctctggaagtcgtgaaaacatacgttcccaaagagttttgaactgaaaacttcaccttccatgcagatatatgcacactttctgagaaggagagacaaatcaagaaacaaactgcacttgttgagcttgtgaaacacaagcccaaggcaacaaaagagcaactgaaagctgtttgagatgatttcgcagcttttgtagagaagtgctgcaaggctgacgataaggagacctgctttgccgaggagggtaaaaaacttgttgctgcaagtcaagctgccttaggcttataacatctacatttaaaagactctcagcctacctgaagaataagagaaagaaatgaaagatcaaaagcttattcatctgttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttctgtgggctaattaaataaatcactaatactcttctaagttaagtttgcagaagtttccaagttagtgacagatcttaccaaagtccacacggaatgctgcctgagagatctgcttgaatgtgctgatgacagggcggaccttgccaagtatatctgtgaaaatcaggattcgatctccagtaaactgaaggaatgctgtgaaaaacctctgttggaaaaatcccactgcattgccgaagtggaaaatgatgagtgacctgctgacttgccttacttagctgctgattttgttgaaagtaaggtgatttgcaaaaacttgactgaggcaaaggatgtcttcctgggctgatttttgtatgaatatgcaagaaggactcctgattactctgtcgtgctgctgctgagacttgccaagaactatgaaaccacagatctgaagtgctgtgccgctgcagatcctactgaatgctatgccaaagtgttcgatgaatttaaacctcttgtggaagagcctcagaatttaatcaaacaaaactgtgagctttttgagcagcttggagagtacaaattccagaatgcgctattagttcgttacaccaagaaagtaccccaagtgtcaactccaactcttgtagaggtctcaagaaacctcggaaaagtgggcagcaaatgttgtaaacatcctgaagcaaaaagatgaccctgtgcagaagactatctatccgtggtcctgaaccagttatgtgtgttgcatgaggatgtcttctggcaatttcatataagtattttttcaaaatgatctcttctgtcaaccccacgcctttggcacatgaaagtgggtaacctttatttcccttctttttctctttagctcggcttattccaggggtgtgtttcgtcgagatgcacacaagagtgaggttgctactcggtttaaagatttgggagaagaaaatttcaaagccttggtgttgattgcctttgctcagtatcttcagcagtgtccatttgaagatactgtaaaattagtgaatgaagtaactgaatttgcaaaaaactgtgtagctgtgaagtcagctgaaaattgtgacaaatcacttcataccctttttggagacaaattatgcacagttgcaactcttcgtgaaaccttgagtgaatgagctgactgctgtgcaaaacaagaacctgagagatgaaaatgcttcttgcaacacaaagtgaacaacccaaacctcccccgattggtcagaccagaggttgatgtgtgatgcactgcttttactgacaatgaagagacatttttgaaaaaatacttattgaaaattgccagaagaactccttactttttgaccccggaactccttttctttgctaaaaggtataaagctgcttttacagaatgttgccaagctgctgataaagctgcctgcctgttgccaaagctcgtgaaacttcgggtgaaagggaaggcttcgtctgccaaacagagactctgaaatgccagtctccaaaaatttggagaaagagctttcaaagcatgggcagtggctcgcctgagccagagatttcccaaagctgagggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttagcctggtgctgtgtcagccccggctagctaactaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagtctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5551 - DNA, 6431 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtgcaagttcatctcattatcgtttaagtactctgtgctggaaacagcacagaatctacttaaacaaggcaaaatgccgtgtttatctcgtcaacttgttggcgagattttttgctagtcgacaacgccagtaagtgacagagtcacaaatgactgcacagagtccttggtgaacaggcgaccatgcttttcagctctggaagtcgtgaaaacatacgttcccaaagagttttgaactgaaaacttcaccttccatgcagatatatgcacactttctgagaaggagagacaaatcaagaaacaaactgcacttgttgagcttgtgaaacacaagcccaaggcaacaaaagagcaactgaaagctgtttgagatgatttcgcagcttttgtagagaagtgctgcaaggctgacgataaggagacctgctttgccgaggagggtaaaaaacttgttgctgcaagtcaagctgccttaggcttataacatctacatttaaaagactctcagcctacctgaagaataagagaaagaaatgaaagatcaaaagcttattcatctgttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttctgtgggctaattaaataaatcactaatactcttctaagttaagtttgcagaagtttccaagttagtgacagatcttaccaaagtccacacggaatgctgcctgagagatctgcttgaatgtgctgatgacagggcggaccttgccaagtatatctgtgaaaatcaggattcgatctccagtaaactgaaggaatgctgtgaaaaacctctgttggaaaaatcccactgcattgccgaagtggaaaatgatgagtgacctgctgacttgccttacttagctgctgattttgttgaaagtaaggtgatttgcaaaaacttgactgaggcaaaggatgtcttcctgggctgatttttgtatgaatatgcaagaaggactcctgattactctgtcgtgctgctgctgagacttgccaagaactatgaaaccacagatctgaagtgctgtgccgctgcagatcctactgaatgctatgccaaagtgttcgatgaatttaaacctcttgtggaagagcctcagaatttaatcaaacaaaactgtgagctttttgagcagcttggagagtacaaattccagaatgcgctattagttcgttacaccaagaaagtaccccaagtgtcaactccaactcttgtagaggtctcaagaaacctcggaaaagtgggcagcaaatgttgtaaacatcctgaagcaaaaagatgaccctgtgcagaagactatctatccgtggtcctgaaccagttatgtgtgttgcatgaggatgtcttctggcaatttcatataagtattttttcaaaatgatctcttctgtcaaccccacgcctttggcacatgaaagtgggtaacctttatttcccttctttttctctttagctcggcttattccaggggtgtgtttcgtcgagatgcacacaagagtgaggttgctactcggtttaaagatttgggagaagaaaatttcaaagccttggtgttgattgcctttgctcagtatcttcagcagtgtccatttgaagatactgtaaaattagtgaatgaagtaactgaatttgcaaaaaactgtgtagctgtgaagtcagctgaaaattgtgacaaatcacttcataccctttttggagacaaattatgcacagttgcaactcttcgtgaaaccttgagtgaatgagctgactgctgtgcaaaacaagaacctgagagatgaaaatgcttcttgcaacacaaagtgaacaacccaaacctcccccgattggtcagaccagaggttgatgtgtgatgcactgcttttactgacaatgaagagacatttttgaaaaaatacttattgaaaattgccagaagaactccttactttttgaccccggaactccttttctttgctaaaaggtataaagctgcttttacagaatgttgccaagctgctgataaagctgcctgcctgttgccaaagctcgtgaaacttcgggtgaaagggaaggcttcgtctgccaaacagagactctgaaatgccagtctccaaaaatttggagaaagagctttcaaagcatgggcagtggctcgcctgagccagagatttcccaaagctgagggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttagcctggtgctgtgtcagccccggctagctaactaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagtctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5552 - DNA, 6431 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgcactaaattgaaagagtgccgtttaagtactctgtgctggaaacagcacagaatctacttaaacaaggcaaaatgccgtgtttatctcgtcaacttgttggcgagattttttgctagtcgacaacgccagtaagtgacagagtcacaaatgactgcacagagtccttggtgaacaggcgaccatgcttttcagctctggaagtcgtgaaaacatacgttcccaaagagttttgaactgaaaacttcaccttccatgcagatatatgcacactttctgagaaggagagacaaatcaagaaacaaactgcacttgttgagcttgtgaaacacaagcccaaggcaacaaaagagcaactgaaagctgtttgagatgatttcgcagcttttgtagagaagtgctgcaaggctgacgataaggagacctgctttgccgaggagggtaaaaaacttgttgctgcaagtcaagctgccttaggcttataacatctacatttaaaagactctcagcctacctgaagaataagagaaagaaatgaaagatcaaaagcttattcatctgttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttctgtgggctaattaaataaatcactaatactcttctaagttaagtttgcagaagtttccaagttagtgacagatcttaccaaagtccacacggaatgctgcctgagagatctgcttgaatgtgctgatgacagggcggaccttgccaagtatatctgtgaaaatcaggattcgatctccagtaaactgaaggaatgctgtgaaaaacctctgttggaaaaatcccactgcattgccgaagtggaaaatgatgagtgacctgctgacttgccttacttagctgctgattttgttgaaagtaaggtgatttgcaaaaacttgactgaggcaaaggatgtcttcctgggctgatttttgtatgaatatgcaagaaggactcctgattactctgtcgtgctgctgctgagacttgccaagaactatgaaaccacagatctgaagtgctgtgccgctgcagatcctactgaatgctatgccaaagtgttcgatgaatttaaacctcttgtggaagagcctcagaatttaatcaaacaaaactgtgagctttttgagcagcttggagagtacaaattccagaatgcgctattagttcgttacaccaagaaagtaccccaagtgtcaactccaactcttgtagaggtctcaagaaacctcggaaaagtgggcagcaaatgttgtaaacatcctgaagcaaaaagatgaccctgtgcagaagactatctatccgtggtcctgaaccagttatgtgtgttgcatgaggatgtcttctggcaatttcatataagtattttttcaaaatgatctcttctgtcaaccccacgcctttggcacatgaaagtgggtaacctttatttcccttctttttctctttagctcggcttattccaggggtgtgtttcgtcgagatgcacacaagagtgaggttgctactcggtttaaagatttgggagaagaaaatttcaaagccttggtgttgattgcctttgctcagtatcttcagcagtgtccatttgaagatactgtaaaattagtgaatgaagtaactgaatttgcaaaaaactgtgtagctgtgaagtcagctgaaaattgtgacaaatcacttcataccctttttggagacaaattatgcacagttgcaactcttcgtgaaaccttgagtgaatgagctgactgctgtgcaaaacaagaacctgagagatgaaaatgcttcttgcaacacaaagtgaacaacccaaacctcccccgattggtcagaccagaggttgatgtgtgatgcactgcttttactgacaatgaagagacatttttgaaaaaatacttattgaaaattgccagaagaactccttactttttgaccccggaactccttttctttgctaaaaggtataaagctgcttttacagaatgttgccaagctgctgataaagctgcctgcctgttgccaaagctcgtgaaacttcgggtgaaagggaaggcttcgtctgccaaacagagactctgaaatgccagtctccaaaaatttggagaaagagctttcaaagcatgggcagtggctcgcctgagccagagatttcccaaagctgagggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttagcctggtgctgtgtcagccccggctagctaactaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagtctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5553 - DNA, 6431 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtagctatcactttctaaagtgtttaagtactctgtgctggaaacagcacagaatctacttaaacaaggcaaaatgccgtgtttatctcgtcaacttgttggcgagattttttgctagtcgacaacgccagtaagtgacagagtcacaaatgactgcacagagtccttggtgaacaggcgaccatgcttttcagctctggaagtcgtgaaaacatacgttcccaaagagttttgaactgaaaacttcaccttccatgcagatatatgcacactttctgagaaggagagacaaatcaagaaacaaactgcacttgttgagcttgtgaaacacaagcccaaggcaacaaaagagcaactgaaagctgtttgagatgatttcgcagcttttgtagagaagtgctgcaaggctgacgataaggagacctgctttgccgaggagggtaaaaaacttgttgctgcaagtcaagctgccttaggcttataacatctacatttaaaagactctcagcctacctgaagaataagagaaagaaatgaaagatcaaaagcttattcatctgttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttctgtgggctaattaaataaatcactaatactcttctaagttaagtttgcagaagtttccaagttagtgacagatcttaccaaagtccacacggaatgctgcctgagagatctgcttgaatgtgctgatgacagggcggaccttgccaagtatatctgtgaaaatcaggattcgatctccagtaaactgaaggaatgctgtgaaaaacctctgttggaaaaatcccactgcattgccgaagtggaaaatgatgagtgacctgctgacttgccttacttagctgctgattttgttgaaagtaaggtgatttgcaaaaacttgactgaggcaaaggatgtcttcctgggctgatttttgtatgaatatgcaagaaggactcctgattactctgtcgtgctgctgctgagacttgccaagaactatgaaaccacagatctgaagtgctgtgccgctgcagatcctactgaatgctatgccaaagtgttcgatgaatttaaacctcttgtggaagagcctcagaatttaatcaaacaaaactgtgagctttttgagcagcttggagagtacaaattccagaatgcgctattagttcgttacaccaagaaagtaccccaagtgtcaactccaactcttgtagaggtctcaagaaacctcggaaaagtgggcagcaaatgttgtaaacatcctgaagcaaaaagatgaccctgtgcagaagactatctatccgtggtcctgaaccagttatgtgtgttgcatgaggatgtcttctggcaatttcatataagtattttttcaaaatgatctcttctgtcaaccccacgcctttggcacatgaaagtgggtaacctttatttcccttctttttctctttagctcggcttattccaggggtgtgtttcgtcgagatgcacacaagagtgaggttgctactcggtttaaagatttgggagaagaaaatttcaaagccttggtgttgattgcctttgctcagtatcttcagcagtgtccatttgaagatactgtaaaattagtgaatgaagtaactgaatttgcaaaaaactgtgtagctgtgaagtcagctgaaaattgtgacaaatcacttcataccctttttggagacaaattatgcacagttgcaactcttcgtgaaaccttgagtgaatgagctgactgctgtgcaaaacaagaacctgagagatgaaaatgcttcttgcaacacaaagtgaacaacccaaacctcccccgattggtcagaccagaggttgatgtgtgatgcactgcttttactgacaatgaagagacatttttgaaaaaatacttattgaaaattgccagaagaactccttactttttgaccccggaactccttttctttgctaaaaggtataaagctgcttttacagaatgttgccaagctgctgataaagctgcctgcctgttgccaaagctcgtgaaacttcgggtgaaagggaaggcttcgtctgccaaacagagactctgaaatgccagtctccaaaaatttggagaaagagctttcaaagcatgggcagtggctcgcctgagccagagatttcccaaagctgagggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttagcctggtgctgtgtcagccccggctagctaactaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagtctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5554 - DNA, 6431 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtaaggttagacattaaagacgtttaagtactctgtgctggaaacagcacagaatctacttaaacaaggcaaaatgccgtgtttatctcgtcaacttgttggcgagattttttgctagtcgacaacgccagtaagtgacagagtcacaaatgactgcacagagtccttggtgaacaggcgaccatgcttttcagctctggaagtcgtgaaaacatacgttcccaaagagttttgaactgaaaacttcaccttccatgcagatatatgcacactttctgagaaggagagacaaatcaagaaacaaactgcacttgttgagcttgtgaaacacaagcccaaggcaacaaaagagcaactgaaagctgtttgagatgatttcgcagcttttgtagagaagtgctgcaaggctgacgataaggagacctgctttgccgaggagggtaaaaaacttgttgctgcaagtcaagctgccttaggcttataacatctacatttaaaagactctcagcctacctgaagaataagagaaagaaatgaaagatcaaaagcttattcatctgttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttctgtgggctaattaaataaatcactaatactcttctaagttaagtttgcagaagtttccaagttagtgacagatcttaccaaagtccacacggaatgctgcctgagagatctgcttgaatgtgctgatgacagggcggaccttgccaagtatatctgtgaaaatcaggattcgatctccagtaaactgaaggaatgctgtgaaaaacctctgttggaaaaatcccactgcattgccgaagtggaaaatgatgagtgacctgctgacttgccttacttagctgctgattttgttgaaagtaaggtgatttgcaaaaacttgactgaggcaaaggatgtcttcctgggctgatttttgtatgaatatgcaagaaggactcctgattactctgtcgtgctgctgctgagacttgccaagaactatgaaaccacagatctgaagtgctgtgccgctgcagatcctactgaatgctatgccaaagtgttcgatgaatttaaacctcttgtggaagagcctcagaatttaatcaaacaaaactgtgagctttttgagcagcttggagagtacaaattccagaatgcgctattagttcgttacaccaagaaagtaccccaagtgtcaactccaactcttgtagaggtctcaagaaacctcggaaaagtgggcagcaaatgttgtaaacatcctgaagcaaaaagatgaccctgtgcagaagactatctatccgtggtcctgaaccagttatgtgtgttgcatgaggatgtcttctggcaatttcatataagtattttttcaaaatgatctcttctgtcaaccccacgcctttggcacatgaaagtgggtaacctttatttcccttctttttctctttagctcggcttattccaggggtgtgtttcgtcgagatgcacacaagagtgaggttgctactcggtttaaagatttgggagaagaaaatttcaaagccttggtgttgattgcctttgctcagtatcttcagcagtgtccatttgaagatactgtaaaattagtgaatgaagtaactgaatttgcaaaaaactgtgtagctgtgaagtcagctgaaaattgtgacaaatcacttcataccctttttggagacaaattatgcacagttgcaactcttcgtgaaaccttgagtgaatgagctgactgctgtgcaaaacaagaacctgagagatgaaaatgcttcttgcaacacaaagtgaacaacccaaacctcccccgattggtcagaccagaggttgatgtgtgatgcactgcttttactgacaatgaagagacatttttgaaaaaatacttattgaaaattgccagaagaactccttactttttgaccccggaactccttttctttgctaaaaggtataaagctgcttttacagaatgttgccaagctgctgataaagctgcctgcctgttgccaaagctcgtgaaacttcgggtgaaagggaaggcttcgtctgccaaacagagactctgaaatgccagtctccaaaaatttggagaaagagctttcaaagcatgggcagtggctcgcctgagccagagatttcccaaagctgagggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttagcctggtgctgtgtcagccccggctagctaactaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagtctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5555 - DNA, 6431 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgctcaccctctcttccccaaagtttaagtactctgtgctggaaacagcacagaatctacttaaacaaggcaaaatgccgtgtttatctcgtcaacttgttggcgagattttttgctagtcgacaacgccagtaagtgacagagtcacaaatgactgcacagagtccttggtgaacaggcgaccatgcttttcagctctggaagtcgtgaaaacatacgttcccaaagagttttgaactgaaaacttcaccttccatgcagatatatgcacactttctgagaaggagagacaaatcaagaaacaaactgcacttgttgagcttgtgaaacacaagcccaaggcaacaaaagagcaactgaaagctgtttgagatgatttcgcagcttttgtagagaagtgctgcaaggctgacgataaggagacctgctttgccgaggagggtaaaaaacttgttgctgcaagtcaagctgccttaggcttataacatctacatttaaaagactctcagcctacctgaagaataagagaaagaaatgaaagatcaaaagcttattcatctgttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttctgtgggctaattaaataaatcactaatactcttctaagttaagtttgcagaagtttccaagttagtgacagatcttaccaaagtccacacggaatgctgcctgagagatctgcttgaatgtgctgatgacagggcggaccttgccaagtatatctgtgaaaatcaggattcgatctccagtaaactgaaggaatgctgtgaaaaacctctgttggaaaaatcccactgcattgccgaagtggaaaatgatgagtgacctgctgacttgccttacttagctgctgattttgttgaaagtaaggtgatttgcaaaaacttgactgaggcaaaggatgtcttcctgggctgatttttgtatgaatatgcaagaaggactcctgattactctgtcgtgctgctgctgagacttgccaagaactatgaaaccacagatctgaagtgctgtgccgctgcagatcctactgaatgctatgccaaagtgttcgatgaatttaaacctcttgtggaagagcctcagaatttaatcaaacaaaactgtgagctttttgagcagcttggagagtacaaattccagaatgcgctattagttcgttacaccaagaaagtaccccaagtgtcaactccaactcttgtagaggtctcaagaaacctcggaaaagtgggcagcaaatgttgtaaacatcctgaagcaaaaagatgaccctgtgcagaagactatctatccgtggtcctgaaccagttatgtgtgttgcatgaggatgtcttctggcaatttcatataagtattttttcaaaatgatctcttctgtcaaccccacgcctttggcacatgaaagtgggtaacctttatttcccttctttttctctttagctcggcttattccaggggtgtgtttcgtcgagatgcacacaagagtgaggttgctactcggtttaaagatttgggagaagaaaatttcaaagccttggtgttgattgcctttgctcagtatcttcagcagtgtccatttgaagatactgtaaaattagtgaatgaagtaactgaatttgcaaaaaactgtgtagctgtgaagtcagctgaaaattgtgacaaatcacttcataccctttttggagacaaattatgcacagttgcaactcttcgtgaaaccttgagtgaatgagctgactgctgtgcaaaacaagaacctgagagatgaaaatgcttcttgcaacacaaagtgaacaacccaaacctcccccgattggtcagaccagaggttgatgtgtgatgcactgcttttactgacaatgaagagacatttttgaaaaaatacttattgaaaattgccagaagaactccttactttttgaccccggaactccttttctttgctaaaaggtataaagctgcttttacagaatgttgccaagctgctgataaagctgcctgcctgttgccaaagctcgtgaaacttcgggtgaaagggaaggcttcgtctgccaaacagagactctgaaatgccagtctccaaaaatttggagaaagagctttcaaagcatgggcagtggctcgcctgagccagagatttcccaaagctgagggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttagcctggtgctgtgtcagccccggctagctaactaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagtctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5556 - DNA, 6431 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgtttcccagagaaaagcaagtgtttaagtactctgtgctggaaacagcacagaatctacttaaacaaggcaaaatgccgtgtttatctcgtcaacttgttggcgagattttttgctagtcgacaacgccagtaagtgacagagtcacaaatgactgcacagagtccttggtgaacaggcgaccatgcttttcagctctggaagtcgtgaaaacatacgttcccaaagagttttgaactgaaaacttcaccttccatgcagatatatgcacactttctgagaaggagagacaaatcaagaaacaaactgcacttgttgagcttgtgaaacacaagcccaaggcaacaaaagagcaactgaaagctgtttgagatgatttcgcagcttttgtagagaagtgctgcaaggctgacgataaggagacctgctttgccgaggagggtaaaaaacttgttgctgcaagtcaagctgccttaggcttataacatctacatttaaaagactctcagcctacctgaagaataagagaaagaaatgaaagatcaaaagcttattcatctgttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttctgtgggctaattaaataaatcactaatactcttctaagttaagtttgcagaagtttccaagttagtgacagatcttaccaaagtccacacggaatgctgcctgagagatctgcttgaatgtgctgatgacagggcggaccttgccaagtatatctgtgaaaatcaggattcgatctccagtaaactgaaggaatgctgtgaaaaacctctgttggaaaaatcccactgcattgccgaagtggaaaatgatgagtgacctgctgacttgccttacttagctgctgattttgttgaaagtaaggtgatttgcaaaaacttgactgaggcaaaggatgtcttcctgggctgatttttgtatgaatatgcaagaaggactcctgattactctgtcgtgctgctgctgagacttgccaagaactatgaaaccacagatctgaagtgctgtgccgctgcagatcctactgaatgctatgccaaagtgttcgatgaatttaaacctcttgtggaagagcctcagaatttaatcaaacaaaactgtgagctttttgagcagcttggagagtacaaattccagaatgcgctattagttcgttacaccaagaaagtaccccaagtgtcaactccaactcttgtagaggtctcaagaaacctcggaaaagtgggcagcaaatgttgtaaacatcctgaagcaaaaagatgaccctgtgcagaagactatctatccgtggtcctgaaccagttatgtgtgttgcatgaggatgtcttctggcaatttcatataagtattttttcaaaatgatctcttctgtcaaccccacgcctttggcacatgaaagtgggtaacctttatttcccttctttttctctttagctcggcttattccaggggtgtgtttcgtcgagatgcacacaagagtgaggttgctactcggtttaaagatttgggagaagaaaatttcaaagccttggtgttgattgcctttgctcagtatcttcagcagtgtccatttgaagatactgtaaaattagtgaatgaagtaactgaatttgcaaaaaactgtgtagctgtgaagtcagctgaaaattgtgacaaatcacttcataccctttttggagacaaattatgcacagttgcaactcttcgtgaaaccttgagtgaatgagctgactgctgtgcaaaacaagaacctgagagatgaaaatgcttcttgcaacacaaagtgaacaacccaaacctcccccgattggtcagaccagaggttgatgtgtgatgcactgcttttactgacaatgaagagacatttttgaaaaaatacttattgaaaattgccagaagaactccttactttttgaccccggaactccttttctttgctaaaaggtataaagctgcttttacagaatgttgccaagctgctgataaagctgcctgcctgttgccaaagctcgtgaaacttcgggtgaaagggaaggcttcgtctgccaaacagagactctgaaatgccagtctccaaaaatttggagaaagagctttcaaagcatgggcagtggctcgcctgagccagagatttcccaaagctgagggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttagcctggtgctgtgtcagccccggctagctaactaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagtctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5557 - DNA, 6431 bp, Artificial Sequence
  Plasmid
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccgacatgagtaataactataatgtttaagtactctgtgctggaaacagcacagaatctacttaaacaaggcaaaatgccgtgtttatctcgtcaacttgttggcgagattttttgctagtcgacaacgccagtaagtgacagagtcacaaatgactgcacagagtccttggtgaacaggcgaccatgcttttcagctctggaagtcgtgaaaacatacgttcccaaagagttttgaactgaaaacttcaccttccatgcagatatatgcacactttctgagaaggagagacaaatcaagaaacaaactgcacttgttgagcttgtgaaacacaagcccaaggcaacaaaagagcaactgaaagctgtttgagatgatttcgcagcttttgtagagaagtgctgcaaggctgacgataaggagacctgctttgccgaggagggtaaaaaacttgttgctgcaagtcaagctgccttaggcttataacatctacatttaaaagactctcagcctacctgaagaataagagaaagaaatgaaagatcaaaagcttattcatctgttttctttttcgttggtgtaaagccaacaccctgtctaaaaaacataaatttctttaatcattttgcctcttttctctgtgcttcaattaataaaaaatggaaagaatctaatagagtggtacagcactgttatttttcaaagatgtgttgctatcctgaaaattctgtaggttctgtggaagttccagtgttctctcttattccacttcggtagaggatttctagtttctgtgggctaattaaataaatcactaatactcttctaagttaagtttgcagaagtttccaagttagtgacagatcttaccaaagtccacacggaatgctgcctgagagatctgcttgaatgtgctgatgacagggcggaccttgccaagtatatctgtgaaaatcaggattcgatctccagtaaactgaaggaatgctgtgaaaaacctctgttggaaaaatcccactgcattgccgaagtggaaaatgatgagtgacctgctgacttgccttacttagctgctgattttgttgaaagtaaggtgatttgcaaaaacttgactgaggcaaaggatgtcttcctgggctgatttttgtatgaatatgcaagaaggactcctgattactctgtcgtgctgctgctgagacttgccaagaactatgaaaccacagatctgaagtgctgtgccgctgcagatcctactgaatgctatgccaaagtgttcgatgaatttaaacctcttgtggaagagcctcagaatttaatcaaacaaaactgtgagctttttgagcagcttggagagtacaaattccagaatgcgctattagttcgttacaccaagaaagtaccccaagtgtcaactccaactcttgtagaggtctcaagaaacctcggaaaagtgggcagcaaatgttgtaaacatcctgaagcaaaaagatgaccctgtgcagaagactatctatccgtggtcctgaaccagttatgtgtgttgcatgaggatgtcttctggcaatttcatataagtattttttcaaaatgatctcttctgtcaaccccacgcctttggcacatgaaagtgggtaacctttatttcccttctttttctctttagctcggcttattccaggggtgtgtttcgtcgagatgcacacaagagtgaggttgctactcggtttaaagatttgggagaagaaaatttcaaagccttggtgttgattgcctttgctcagtatcttcagcagtgtccatttgaagatactgtaaaattagtgaatgaagtaactgaatttgcaaaaaactgtgtagctgtgaagtcagctgaaaattgtgacaaatcacttcataccctttttggagacaaattatgcacagttgcaactcttcgtgaaaccttgagtgaatgagctgactgctgtgcaaaacaagaacctgagagatgaaaatgcttcttgcaacacaaagtgaacaacccaaacctcccccgattggtcagaccagaggttgatgtgtgatgcactgcttttactgacaatgaagagacatttttgaaaaaatacttattgaaaattgccagaagaactccttactttttgaccccggaactccttttctttgctaaaaggtataaagctgcttttacagaatgttgccaagctgctgataaagctgcctgcctgttgccaaagctcgtgaaacttcgggtgaaagggaaggcttcgtctgccaaacagagactctgaaatgccagtctccaaaaatttggagaaagagctttcaaagcatgggcagtggctcgcctgagccagagatttcccaaagctgagggccccagaagcctggtggttgtttgtccttctcaggggaaaagtgaggcggccccttggaggaaggggccgggcagaatgatctaatcggattccaagcagctcaggggattgtctttttctagcaccttcttgccactcctaagcgtcctccgtgaccccggctgggatttagcctggtgctgtgtcagccccggctagctaactaccggtgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtactcagatctcgagctcaagtagtctagagctcgctgatcagcctcgaaacttgtttattgcagcttataatggttacaaataaagcaatagcatcacaaatttcacaaataaagcatttttttcactgcattctagttgtggtttgtccaaactcatcaatgtatcttatcatgtctgtataccagcaggctttcctaggttctcacgtgcggaccgaggctgcagcgtcgtcctccctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 5558 - DNA, 22 bp, Artificial Sequence
  oligonucleotide primer
ccaaccgtacacagagtatatg

SEQ ID NO: 5559 - DNA, 22 bp, Artificial Sequence
  oligonucleotide primer
cttgacttcacatccagaagaa

SEQ ID NO: 5560 - DNA, 23 bp, Artificial Sequence
  oligonucleotide probe
agtagattcgctgctcttgttgc

SEQ ID NO: 5561 - DNA, 23 bp, Artificial Sequence
  oligonucleotide probe
agaggacaaacctggacctgtag

SEQ ID NO: 5562 - DNA, 70 bp, Artificial Sequence
  Synthetic
atcatgaaattgaaattgaacacctctcctttcccaagataagagatcatctttaagaaaaggctgtgta

SEQ ID NO: 5563 - DNA, 70 bp, Artificial Sequence
  Synthetic
tagtactttaactttaacttgtggagaggaaagggttctattctctagtagaaattcttttccgacacat

SEQ ID NO: 5564 - DNA, 79 bp, Artificial Sequence
  Synthetic
gaaattgaaattgaacacctctcctttcccaagataagagatcatctttaagaaaaggctgtgtattgtgggggtttga

SEQ ID NO: 5565 - DNA, 85 bp, Artificial Sequence
  Synthetic
atcatgaaattgaaattgaacacctctcctttcccaaggtaagagatcatctttaagaaaaggctgtgtattgtgggggtttgaa

SEQ ID NO: 5566 - DNA, 85 bp, Artificial Sequence
  Synthetic
tagtactttaactttaacttgtggagaggaaagggttccattctctagtagaaattcttttccgacacataacacccccaaactt

SEQ ID NO: 5567 - DNA, 95 bp, Artificial Sequence
  Synthetic
atgtatgctggcttttaagggggaaacaaatcatgaaattgaaattgaacacctctcctttcccaaggtaagagatcatctttaagaaaaggctg

SEQ ID NO: 5568 - DNA, 95 bp, Artificial Sequence
  Synthetic
tacatacgaccgaaaattccccctttgtttagtactttaactttaacttgtggagaggaaagggttccattctctagtagaaattcttttccgac
